United States Patent
Pompejus et al.

(10) Patent No.: US 7,270,984 B1
(45) Date of Patent: Sep. 18, 2007

(54) POLYNUCLEOTIDES ENCODING A 6-PHOSPHOGLUCONOLACTONASE POLYPEPTIDE FROM CORYNEBACTERIUM GLUTAMICUM

(75) Inventors: Markus Pompejus, Freinsheim (DE); Burkhard Kröger, Limburgerhof (DE); Hartwig Schröder, Nussloch (DE); Oskar Zelder, Speyer (DE); Gregor Haberhauer, Limburgerhof (DE)

(73) Assignee: BASF Aktiengesellschaft (DE)

( * ) Notice: Subject to any disclaimer, the term of this patent is extended or adjusted under 35 U.S.C. 154(b) by 921 days.

(21) Appl. No.: 09/602,740

(22) Filed: Jun. 23, 2000

Related U.S. Application Data

(60) Provisional application No. 60/141,031, filed on Jun. 25, 1999, provisional application No. 60/143,208, filed on Jul. 9, 1999, provisional application No. 60/151,572, filed on Aug. 31, 1999.

(51) Int. Cl.
*C12P 13/04* (2006.01)
*C12N 9/18* (2006.01)
*C12N 1/20* (2006.01)
*C12N 15/00* (2006.01)
*C07H 21/04* (2006.01)

(52) U.S. Cl. ............ 435/106; 435/41; 435/69.1; 435/183; 435/195; 435/196; 435/197; 435/252.3; 435/320.1; 536/23.2

(58) Field of Classification Search ........ 536/23.1, 536/23.2; 435/320.1, 252.3, 254.11, 419, 435/325, 252.32, 41, 106, 183, 195, 196, 435/197, 69.1
See application file for complete search history.

(56) References Cited

U.S. PATENT DOCUMENTS

2002/0197605 A1* 12/2002 Nakagawa et al. ............ 435/6

FOREIGN PATENT DOCUMENTS

| EP | 1108790 A2 | * | 6/2001 |
| WO | WO-01/04322 A2 | * | 1/2001 |
| WO | WO 01/04325 | * | 1/2001 |

OTHER PUBLICATIONS

Marra et al. GenBank Accession No. AA915356 (Apr. 1998) vz29z08.r1 Soares_thymus_2NbMT *Mus musculus* cDNA clone.*
Ma et al. Cloning and Characterization of the *Pseudomonas aeruginosa* zwf Gene Encoding Glucose-6-Phophate Dehydrogenase, an Enzymes Important in Resistance to Methyl Viologen (Paraquat) J. Bacteriol. (Apr. 1998) 180(7):1741-1749.*
Krubasik et al. GenBank Accession No. NP_600792 (Mar. 2001) 6-phosphogluconolactonase/Glucosamine-6-phosphate isomerase/deaminase. A 235 amino acid protein from *C. glutamicum*.*
EMBL Accession No. O06814 for "6-phosphogluconolactonase (EC 3.1.1.31) (6PGL)."(Nov. 1, 1997).

Bathe, B., et al. "A physical and genetic map of the *Corynebacterium glutamicum* ATCC 13032 chromosome." *Mol Gen Genet.* Sep. 3, 1996; 252930:255-65.
Cole, S.T., et al. "Deciphering the biology of *Mycobacterium tuberculosis* from the complete genome sequence." *Nature.* 1998 Jun. 11; 393(6685):537-44.
Eikmanns, B.J., et al. "The phosphoenolpyruvate carboxylase gene of *Corynebacterium glutamicum*:Molecular cloning, nucleotide sequence, and expression." *Mol Gen Genet.* Aug. 1989; 218(2):330-9.
Peters-Wendisch, P.G., et al. "Pyrvuate carboxylase as an anaplerotic enzyme in *Corynebacterium gluamicum.*" *Microbiolgy.* Apr. 1997; 143:1095-103.
Genbank Accession #CAB66415. 6-phosphogluconolactonase-like protein (*Arabidopsis thaliana*). Jan. 19, 2000.
Genbank Accession #AL132956. *Arabidopsis thaliana* DNA chromosome 3, BAC clone F2K15. Jan. 19, 2000.
Genbank Accession #CAB57866. 6 phosphogluconolactonase (*Homo sapiens*). Oct. 8, 1999.
Genbank Accession #HSA243972. *Homo sapiens* mRNA for 6 phosphogluconolactonase (6PGLgene). Oct. 8, 1999.
Genbank Accession #AF029673. *Pseudomonas aeruginosa* HexR (hexR), glucose-6-phosphate 1-dehydrogenase (zwf), 6-phosphogluconolactonase (pgl), and 2-keto-3deoxy-6-phosphogluconate aldolase (eda) genes, complete cds. Apr. 2, 1999.
Genbank Accession #AAD22666. 6-phosphogluconolactonase (*Pseudomonas aeruginosa*). Apr. 2, 1999.
Collard F, Collet JF, Gerin I, Veiga-da-Cunha M, Van Schaftingen E. Identification of the cDNA encoding human 6-phosphogluconolactonase, the enzyme catalyzing the second step of the pentose phosphate pathway(1). FEBS Lett. Oct. 8, 1999; 459(2):223-6.
Ma JF, Hager PW, Howell ML, Phibbs PV, Hassett DJ. Cloning and characterization of the *Pseudomonas aeruginosa* zwf gene encoding glucose-6- phosphate dehydrogenase, and enzyme important in resistance to methyl viologen (paraquat). J Bacteriol. Apr. 1998; 180(7):1741-9.

(Continued)

*Primary Examiner*—Ponnathafu Achuvamurthy
*Assistant Examiner*—Christian L. Fronda
(74) *Attorney, Agent, or Firm*—Lahive & Cockfield, LLP; Elizabeth A. Hanley; Maria Laccotripe Zacharakis

(57) ABSTRACT

Isolated nucleic acid molecules, designated sugar metabolism and oxidative phosphorylation (SMP) nucleic acid molecules, which encode novel SMP proteins from *Corynebacterium glutamicum*, are described. The invention also provides antisense nucleic acid molecules, recombinant expression vectors containing SMP nucleic acid molecules, and host cells into which the expression vectors have been introduced. The invention still further provides isolated SMP proteins, mutated SMP proteins, fusion proteins, antigenic peptides and methods for the improvement of production of a desired compound from *C. glutamicum* based on genetic engineering of SMP genes in this organism.

21 Claims, No Drawings

OTHER PUBLICATIONS

Broun, Pierre et al., "Catalytic Plasticity of Fatty Acid Modification Enzymes Underlying Chemical Diversity of Plant Lipids," *Science*, vol. 282:1315-1317 (1998).

Ng, David H.W. et al., "Point Mutation in the Second Phosphatase Domain of CD45 Abrogates Tyrosine Phosphatase Activity,"*Biochemical and Biophysical Research Communications*, vol. 206(1):302-309 (1995).

* cited by examiner

US 7,270,984 B1

POLYNUCLEOTIDES ENCODING A 6-PHOSPHOGLUCONOLACTONASE POLYPEPTIDE FROM CORYNEBACTERIUM GLUTAMICUM

RELATED APPLICATIONS

This application claims priority to prior U.S. Provisional Patent Application Ser. No. 60/141,031, filed Jun. 25, 1999, U.S. Provisional Patent Application Ser. No. 60/143,208, filed Jul. 9, 1999, and U.S. Provisional Patent Application Ser. No. 60/151,572, filed Aug. 31, 1999. This application also claims priority to prior German Patent Application No. 19931412.8, filed Jul. 8, 1999, German Patent Application No. 19931413.6, filed Jul. 8, 1999, German Patent Application No. 19931419.5, filed Jul. 8, 1999, German Patent Application No. 19931420.9, filed Jul. 8, 1999, German Patent Application No. 19931424.1, filed Jul. 8, 1999, German Patent Application No. 19931428.4, filed Jul. 8, 1999, German Patent Application No. 19931431.4, filed Jul. 8, 1999, German Patent Application No. 19931433.0, filed Jul. 8, 1999, German Patent Application No. 19931434.9, filed Jul. 8, 1999, German Patent Application No. 19931510.8, filed Jul. 8, 1999, German Patent Application No. 19931562.0, filed Jul. 8, 1999, German Patent Application No. 19931634.1, filed Jul. 8, 1999, German Patent Application No. 19932180.9, filed Jul. 9, 1999, German Patent Application No. 19932227.9, filed Jul. 9, 1999, German Patent Application No. 19932230.9, filed Jul. 9, 1999, German Patent Application No. 19932924.9, filed Jul. 14, 1999, German Patent Application No. 19932973.7, filed Jul. 14, 1999, German Patent Application No. 19933005.0, filed Jul. 14, 1999, German Patent Application No. 19940765.7, filed Aug. 27, 1999, German Patent Application No. 19942076.9, filed Sep. 3, 1999, German Patent Application No. 19942079.3, filed Sep. 3, 1999, German Patent Application No. 19942086.6, filed Sep. 3, 1999, German Patent Application No. 19942087.4, filed Sep. 3, 1999, German Patent Application No. 19942088.2, filed Sep. 3, 1999, German Patent Application No. 19942095.5, filed Sep. 3, 1999, German Patent Application No. 19942123.4, filed Sep. 3, 1999, and German Patent Application No. 19942125.0, filed Sep. 3, 1999. The entire contents of all of the aforementioned application are hereby expressly incorporated herein by this reference.

BACKGROUND OF THE INVENTION

Certain products and by-products of naturally-occurring metabolic processes in cells have utility in a wide array of industries, including the food, feed, cosmetics, and pharmaceutical industries. These molecules, collectively termed 'fine chemicals', include organic acids, both proteinogenic and non-proteinogenic amino acids, nucleotides and nucleosides, lipids and fatty acids, diols, carbohydrates, aromatic compounds, vitamins and cofactors, and enzymes. Their production is most conveniently performed through the large-scale culture of bacteria developed to produce and secrete large quantities of one or more desired molecules. One particularly useful organism for this purpose is *Corynebacterium glutamicum*, a gram positive, nonpathogenic bacterium. Through strain selection, a number of mutant strains have been developed which produce an array of desirable compounds. However, selection of strains improved for the production of a particular molecule is a time-consuming and difficult process.

SUMMARY OF THE INVENTION

The invention provides novel bacterial nucleic acid molecules which have a variety of uses. These uses include the identification of microorganisms which can be used to produce fine chemicals, the modulation of fine chemical production in *C. glutamicum* or related bacteria, the typing or identification of *C. glutamicum* or related bacteria, as reference points for mapping the *C. glutamicum* genome, and as markers for transformation. These novel nucleic acid molecules encode proteins, referred to herein as sugar metabolism and oxidative phosphorylation (SMP) proteins.

*C. glutamicum* is a gram positive, aerobic bacterium which is commonly used in industry for the large-scale production of a variety of fine chemicals, and also for the degradation of hydrocarbons (such as in petroleum spills) and for the oxidation of terpenoids. The SMP nucleic acid molecules of the invention, therefore, can be used to identify microorganisms which can be used to produce fine chemicals, e.g., by fermentation processes. Modulation of the expression of the SMP nucleic acids of the invention, or modification of the sequence of the SMP nucleic acid molecules of the invention, can be used to modulate the production of one or more fine chemicals from a microorganism (e.g., to improve the yield or production of one or more fine chemicals from a *Corynebacterium* or *Brevibacterium* species).

The SMP nucleic acids of the invention may also be used to identify an organism as being *Corynebacterium glutamicum* or a close relative thereof, or to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is nonpathogenic, it is related to species pathogenic in humans, such as *Corynebacterium diphtheriae* (the causative agent of diphtheria); the detection of such organisms is of significant clinical relevance.

The SMP nucleic acid molecules of the invention may also serve as reference points for mapping of the *C. glutamicum* genome, or of genomes of related organisms. Similarly, these molecules, or variants or portions thereof, may serve as markers for genetically engineered *Corynebacterium* or *Brevibacterium* species. e.g. e.g. The SMP proteins encoded by the novel nucleic acid molecules of the invention are capable of, for example, performing a function involved in the metabolism of carbon compounds such as sugars or in the generation of energy molecules by processes such as oxidative phosphorylation in *Corynebacterium glutamicum*. Given the availability of cloning vectors for use in *Corynebacterium glutamicum*, such as those disclosed in Sinskey et al., U.S. Pat. No. 4,649,119, and techniques for genetic manipulation of *C. glutamicum* and the related *Brevibacterium* species (e.g., *lactofermentum*) (Yoshihama et al, *J. Bacteriol.* 162: 591-597 (1985); Katsumata et al., *J. Bacteriol.* 159: 306-311 (1984); and Santamaria et al., *J. Gen. Microbiol.* 130: 2237-2246 (1984)), the nucleic acid molecules of the invention may be utilized in the genetic engineering of this organism to make it a better or more efficient producer of one or more fine chemicals. This improved production or efficiency of production of a fine chemical may be due to a direct effect of manipulation of a gene of the invention, or it may be due to an indirect effect of such manipulation.

There are a number of mechanisms by which the alteration of an SMP protein of the invention may directly affect the yield, production, and/or efficiency of production of a fine chemical from a *C. glutamicum* strain incorporating such an altered protein. The degradation of high-energy carbon molecules such as sugars, and the conversion of compounds such as NADH and $FADH_2$ to compounds containing high energy phosphate bonds via oxidative phosphorylation results in a number of compounds which themselves may be desirable fine chemicals, such as pyruvate, ATP, NADH, and a number of intermediate sugar compounds. Further, the energy molecules (such as ATP) and the reducing equivalents (such as NADH or NADPH) produced by these metabolic pathways are utilized in the cell to drive reactions which would otherwise be energetically unfavorable. Such unfavorable reactions include many biosynthetic pathways for fine chemicals. By improving the ability of the cell to utilize a particular sugar (e.g., by manipulating the genes encoding enzymes involved in the degradation and conversion of that sugar into energy for the cell), one may increase the amount of energy available to permit unfavorable, yet desired metabolic reactions (e.g., the biosynthesis of a desired fine chemical) to occur.

The mutagenesis of one or more SMP genes of the invention may also result in SMP proteins having altered activities which indirectly impact the production of one or more desired fine chemicals from *C. glutamicum*. For example, by increasing the efficiency of utilization of one or more sugars (such that the conversion of the sugar to useful energy molecules is improved), or by increasing the efficiency of conversion of reducing equivalents to useful energy molecules (e.g., by improving the efficiency of oxidative phosphorylation, or the activity of the ATP synthase), one can increase the amount of these high-energy compounds available to the cell to drive normally unfavorable metabolic processes. These processes include the construction of cell walls, transcription, translation, and the biosynthesis of compounds necessary for growth and division of the cells (e.g., nucleotides, amino acids, vitamins, lipids, etc.) (Lengeler et al. (1999) Biology of Prokaryotes, Thieme Verlag: Stuttgart, p. 88-109; 913-918; 875-899). By improving the growth and multiplication of these engineered cells, it is possible to increase both the viability of the cells in large-scale culture, and also to improve their rate of division, such that a relatively larger number of cells can survive in fermentor culture. The yield, production, or efficiency of production may be increased, at least due to the presence of a greater number of viable cells, each producing the desired fine chemical. Also, many of the degradation products produced during sugar metabolism are utilized by the cell as precursors or intermediates in the production of other desirable products, such as fine chemicals. So, by increasing the ability of the cell to metabolize sugars, the number of these degradation products available to the cell for other processes should also be increased.

The invention provides novel nucleic acid molecules which encode proteins, referred to herein as SMP proteins, which are capable of, for example, performing a function involved in the metabolism of carbon compounds such as sugars and the generation of energy molecules by processes such as oxidative phosphorylation in *Corynebacterium glutamicum*. Nucleic acid molecules encoding an SMP protein are referred to herein as SMP nucleic acid molecules. In a preferred embodiment, the SMP protein participates in the conversion of carbon molecules and degradation products thereof to energy which is utilized by the cell for metabolic processes. Examples of such proteins include those encoded by the genes set forth in Table 1.

Accordingly, one aspect of the invention pertains to isolated nucleic acid molecules (e.g., cDNAs, DNAs, or RNAs) comprising a nucleotide sequence encoding an SMP protein or biologically active portions thereof, as well as nucleic acid fragments suitable as primers or hybridization probes for the detection or amplification of SMP-encoding nucleic acid (e.g., DNA or mRNA). In particularly preferred embodiments, the isolated nucleic acid molecule comprises one of the nucleotide sequences set forth in Appendix A or the coding region or a complement thereof of one of these nucleotide sequences. In other particularly preferred embodiments, the isolated nucleic acid molecule of the invention comprises a nucleotide sequence which hybridizes to or is at least about 50%, preferably at least about 60%, more preferably at least about 70%, 80% or 90%, and even more preferably at least about 95%, 96%, 97%, 98%, 99% or more homologous to a nucleotide sequence set forth in Appendix A, or a portion thereof. In other preferred embodiments, the isolated nucleic acid molecule encodes one of the amino acid sequences set forth in Appendix B. The preferred SMP proteins of the present invention also preferably possess at least one of the SMP activities described herein.

In another embodiment, the isolated nucleic acid molecule encodes a protein or portion thereof wherein the protein or portion thereof includes an amino acid sequence which is sufficiently homologous to an amino acid sequence of Appendix B, e.g., sufficiently homologous to an amino acid sequence of Appendix B such that the protein or portion thereof maintains an SMP activity. Preferably, the protein or portion thereof encoded by the nucleic acid molecule maintains the ability to perform a function involved in the metabolism of carbon compounds such as sugars or the generation of energy molecules (e.g., ATP) by processes such as oxidative phosphorylation in *Corynebacterium glutamicum*. In one embodiment, the protein encoded by the nucleic acid molecule is at least about 50%, preferably at least about 60%, and more preferably at least about 70%, 80%, or 90% and most preferably at least about 95%, 96%, 97%, 98%, or 99% or more homologous to an amino acid sequence of Appendix B (e.g., an entire amino acid sequence selected from those sequences set forth in Appendix B). In another preferred embodiment, the protein is a full length *C. glutamicum* protein which is substantially homologous to an entire amino acid sequence of Appendix B (encoded by an open reading frame shown in Appendix A).

In another preferred embodiment, the isolated nucleic acid molecule is derived from *C. glutamicum* and encodes a protein (e.g., an SMP fusion protein) which includes a biologically active domain which is at least about 50% or more homologous to one of the amino acid sequences of Appendix B and is able to perform a function involved in the metabolism of carbon compounds such as sugars or the generation of energy molecules (e.g., ATP) by processes such as oxidative phosphorylation in *Corynebacterium glutamicum*, or has one or more of the activities set forth in Table 1, and which also includes heterologous nucleic acid sequences encoding a heterologous polypeptide or regulatory regions.

In another embodiment, the isolated nucleic acid molecule is at least 15 nucleotides in length and hybridizes under stringent conditions to a nucleic acid molecule comprising a nucleotide sequence of Appendix A. Preferably, the isolated nucleic acid molecule corresponds to a naturally-occurring nucleic acid molecule. More preferably, the isolated nucleic acid encodes a naturally-occurring *C. glutamicum* SMP protein, or a biologically active portion thereof.

Another aspect of the invention pertains to vectors, e.g., recombinant expression vectors, containing the nucleic acid molecules of the invention, and host cells into which such vectors have been introduced. In one embodiment, such a host cell is used to produce an SMP protein by culturing the host cell in a suitable medium. The SMP protein can be then isolated from the medium or the host cell.

Yet another aspect of the invention pertains to a genetically altered microorganism in which an SMP gene has been introduced or altered. In one embodiment, the genome of the microorganism has been altered by introduction of a nucleic acid molecule of the invention encoding wild-type or mutated SMP sequence as a transgene. In another embodiment, an endogenous SMP gene within the genome of the microorganism has been altered, e.g., functionally disrupted, by homologous recombination with an altered SMP gene. In another embodiment, an endogenous or introduced SMP gene in a microorganism has been altered by one or more point mutations, deletions, or inversions, but still encodes a functional SMP protein. In still another embodiment, one or more of the regulatory regions (e.g., a promoter, repressor, or inducer) of an SMP gene in a microorganism has been altered (e.g., by deletion, truncation, inversion, or point mutation) such that the expression of the SMP gene is modulated. In a preferred embodiment, the microorganism belongs to the genus *Corynebacterium* or *Brevibacterium*, with *Corynebacterium glutamicum* being particularly preferred. In a preferred embodiment, the microorganism is also utilized for the production of a desired compound, such as an amino acid, with lysine being particularly preferred.

In another aspect, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject.

Still another aspect of the invention pertains to an isolated SMP protein or a portion, e.g., a biologically active portion, thereof. In a preferred embodiment, the isolated SMP protein or portion thereof is capable of performing a function involved in the metabolism of carbon compounds such as sugars or in the generation of energy molecules (e.g., ATP) by processes such as oxidative phosphorylation in *Corynebacterium glutamicum*. In another preferred embodiment, the isolated SMP protein or portion thereof is sufficiently homologous to an amino acid sequence of Appendix B such that the protein or portion thereof maintains the ability to perform a function involved in the metabolism of carbon compounds such as sugars or in the generation of energy molecules (e.g., ATP) by processes such as oxidative phosphorylation in *Corynebacterium glutamicum*.

The invention also provides an isolated preparation of an SMP protein. In preferred embodiments, the SMP protein comprises an amino acid sequence of Appendix B. In another preferred embodiment, the invention pertains to an isolated full length protein which is substantially homologous to an entire amino acid sequence of Appendix B (encoded by an open reading frame set forth in Appendix A). In yet another embodiment, the protein is at least about 50%, preferably at least about 60%, and more preferably at least about 70%, 80%, or 90%, and most preferably at least about 95%, 96%, 97%, 98%, or 99% or more homologous to an entire amino acid sequence of Appendix B. In other embodiments, the isolated SMP protein comprises an amino acid sequence which is at least about 50% or more homologous to one of the amino acid sequences of Appendix B and is able to perform a function involved in the metabolism of carbon compounds such as sugars or in the generation of energy molecules (e.g., ATP) by processes such as oxidative phosphorylation in *Corynebacterium glutamicum*, or has one or more of the activities set forth in Table 1.

Alternatively, the isolated SMP protein can comprise an amino acid sequence which is encoded by a nucleotide sequence which hybridizes, e.g., hybridizes under stringent conditions, or is at least about 50%, preferably at least about 60%, more preferably at least about 70%, 80%, or 90%, and even more preferably at least about 95%, 96%, 97%, 98,%, or 99% or more homologous, to a nucleotide sequence of Appendix B. It is also preferred that the preferred forms of SMP proteins also have one or more of the SMP bioactivities described herein.

The SMP polypeptide, or a biologically active portion thereof, can be operatively linked to a non-SMP polypeptide to form a fusion protein. In preferred embodiments, this fusion protein has an activity which differs from that of the SMP protein alone. In other preferred embodiments, this fusion protein performs a function involved in the metabolism of carbon compounds such as sugars or in the generation of energy molecules (e.g., ATP) by processes such as oxidative phosphorylation in *Corynebacterium glutamicum*. In particularly preferred embodiments, integration of this fusion protein into a host cell modulates production of a desired compound from the cell.

In another aspect, the invention provides methods for screening molecules which modulate the activity of an SMP protein, either by interacting with the protein itself or a substrate or binding partner of the SMP protein, or by modulating the transcription or translation of an SMP nucleic acid molecule of the invention.

Another aspect of the invention pertains to a method for producing a fine chemical. This method involves the culturing of a cell containing a vector directing the expression of an SMP nucleic acid molecule of the invention, such that a fine chemical is produced. In a preferred embodiment, this method further includes the step of obtaining a cell containing such a vector, in which a cell is transfected with a vector directing the expression of an SMP nucleic acid. In another preferred embodiment, this method further includes the step of recovering the fine chemical from the culture. In a particularly preferred embodiment, the cell is from the genus *Corynebacterium* or *Brevibacterium*, or is selected from those strains set forth in Table 3.

Another aspect of the invention pertains to methods for modulating production of a molecule from a microorganism. Such methods include contacting the cell with an agent which modulates SMP protein activity or SMP nucleic acid expression such that a cell associated activity is altered relative to this same activity in the absence of the agent. In a preferred embodiment, the cell is modulated for one or more *C. glutamicum* carbon metabolism pathways or for the production of energy through processes such as oxidative phosphorylation, such that the yields or rate of production of a desired fine chemical by this microorganism is improved. The agent which modulates SMP protein activity can be an agent which stimulates SMP protein activity or SMP nucleic acid expression. Examples of agents which stimulate SMP protein activity or SMP nucleic acid expression include small molecules, active SMP proteins, and nucleic acids encoding SMP proteins that have been introduced into the cell. Examples of agents which inhibit SMP activity or expression include small molecules and antisense SMP nucleic acid molecules.

Another aspect of the invention pertains to methods for modulating yields of a desired compound from a cell, involving the introduction of a wild-type or mutant SMP gene into a cell, either maintained on a separate plasmid or integrated into the genome of the host cell. If integrated into the genome, such integration can be random, or it can take place by homologous recombination such that the native gene is replaced by the introduced copy, causing the production of the desired compound from the cell to be modulated. In a preferred embodiment, said yields are increased. In another preferred embodiment, said chemical is a fine chemical. In a particularly preferred embodiment, said fine chemical is an amino acid. In especially preferred embodiments, said amino acid is L-lysine.

DETAILED DESCRIPTION OF THE INVENTION

The present invention provides SMP nucleic acid and protein molecules which are involved in the metabolism of carbon compounds such as sugars and the generation of energy molecules by processes such as oxidative phosphorylation in *Corynebacterium glutamicum*. The molecules of the invention may be utilized in the modulation of production of fine chemicals from microorganisms, such as *C. glutamicum*, either directly (e.g., where overexpression or optimization of a glycolytic pathway protein has a direct impact on the yield, production, and/or efficiency of production of, e.g., pyruvate from modified *C. glutamicum*), or may have an indirect impact which nonetheless results in an increase of yield, production, and/or efficiency of production of the desired compound (e.g., where modulation of proteins involved in oxidative phosphorylation results in alterations in the amount of energy available to perform necessary metabolic processes and other cellular functions, such as nucleic acid and protein biosynthesis and transcription/translation). Aspects of the invention are further explicated below.

I. Fine Chemicals

The term 'fine chemical' is art-recognized and includes molecules produced by an organism which have applications in various industries, such as, but not limited to, the pharmaceutical, agriculture, and cosmetics industries. Such compounds include organic acids, such as tartaric acid, itaconic acid, and diaminopimelic acid, both proteinogenic and non-proteinogenic amino acids, purine and pyrimidine bases, nucleosides, and nucleotides (as described e.g. in Kuninaka, A. (1996) Nucleotides and related compounds, p. 561-612, in Biotechnology vol. 6, Rehm et al., eds. VCH: Weinheim, and references contained therein), lipids, both saturated and unsaturated fatty acids (e.g., arachidonic acid), diols (e.g., propane diol, and butane diol), carbohydrates (e.g., hyaluronic acid and trehalose), aromatic compounds (e.g., aromatic amines, vanillin, and indigo), vitamins and cofactors (as described in Ullmann's Encyclopedia of Industrial Chemistry, vol. A27, "Vitamins", p. 443-613 (1996) VCH: Weinheim and references therein; and Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1-3, 1994 at Penang, Malaysia, AOCS Press, (1995)), enzymes, polyketides (Cane et al. (1998) *Science* 282: 63-68), and all other chemicals described in Gutcho (1983) *Chemicals by Fermentation*, Noyes Data Corporation, ISBN: 0818805086 and references therein. The metabolism and uses of certain of these fine chemicals are further explicated below.

A. Amino Acid Metabolism and Uses

Amino acids comprise the basic structural units of all proteins, and as such are essential for normal cellular functioning in all organisms. The term "amino acid" is art-recognized. The proteinogenic amino acids, of which there are 20 species, serve as structural units for proteins, in which they are linked by peptide bonds, while the nonproteinogenic amino acids (hundreds of which are known) are not normally found in proteins (see Ulmann's Encyclopedia of Industrial Chemistry, vol. A2, p. 57-97 VCH: Weinheim (1985)). Amino acids may be in the D- or L-optical configuration, though L-amino acids are generally the only type found in naturally-occurring proteins. Biosynthetic and degradative pathways of each of the 20 proteinogenic amino acids have been well characterized in both prokaryotic and eukaryotic cells (see, for example, Stryer, L. Biochemistry, $3^{rd}$ edition, pages 578-590 (1988)). The 'essential' amino acids (histidine, isoleucine, leucine, lysine, methionine, phenylalanine, threonine, tryptophan, and valine), so named because they are generally a nutritional requirement due to the complexity of their biosyntheses, are readily converted by simple biosynthetic pathways to the remaining 11 'nonessential' amino acids (alanine, arginine, asparagine, aspartate, cysteine, glutamate, glutamine, glycine, proline, serine, and tyrosine). Higher animals do retain the ability to synthesize some of these amino acids, but the essential amino acids must be supplied from the diet in order for normal protein synthesis to occur.

Aside from their function in protein biosynthesis, these amino acids are interesting chemicals in their own right, and many have been found to have various applications in the food, feed, chemical, cosmetics, agriculture, and pharmaceutical industries. Lysine is an important amino acid in the nutrition not only of humans, but also of monogastric animals such as poultry and swine. Glutamate is most commonly used as a flavor additive (mono-sodium glutamate, MSG) and is widely used throughout the food industry, as are aspartate, phenylalanine, glycine, and cysteine. Glycine, L-methionine and tryptophan are all utilized in the pharmaceutical industry. Glutamine, valine, leucine, isoleucine, histidine, arginine, proline, serine and alanine are of use in both the pharmaceutical and cosmetics industries. Threonine, tryptophan, and D/L-methionine are common feed additives. (Leuchtenberger, W. (1996) Amino aids—technical production and use, p. 466-502 in Rehm et al. (eds.) Biotechnology vol. 6, chapter 14a, VCH: Weinheim). Additionally, these amino acids have been found to be useful as precursors for the synthesis of synthetic amino acids and proteins, such as N-acetylcysteine, S-carboxymethyl-L-cysteine, (S)-5-hydroxytryptophan, and others described in Ulmann's Encyclopedia of Industrial Chemistry, vol. A2, p. 57-97, VCH: Weinheim, 1985.

The biosynthesis of these natural amino acids in organisms capable of producing them, such as bacteria, has been well characterized (for review of bacterial amino acid biosynthesis and regulation thereof, see Umbarger, H. E. (1978) *Ann. Rev. Biochem.* 47: 533-606). Glutamate is synthesized by the reductive amination of α-ketoglutarate, an intermediate in the citric acid cycle. Glutamine, proline, and arginine are each subsequently produced from glutamate. The biosynthesis of serine is a three-step process beginning with 3-phosphoglycerate (an intermediate in glycolysis), and resulting in this amino acid after oxidation, transamination, and hydrolysis steps. Both cysteine and glycine are produced from serine; the former by the condensation of homocysteine with serine, and the latter by the transferal of the side-chain β-carbon atom to tetrahydrofolate, in a reaction catalyzed by serine transhydroxymethylase. Phenylalanine, and tyrosine are synthesized from the glycolytic and pentose phosphate pathway precursors erythrose 4-phosphate and phosphoenolpyruvate in a 9-step biosynthetic pathway that differ only at the final two steps after synthesis of prephenate. Tryptophan is also produced from these two initial molecules, but its synthesis is an 11-step pathway. Tyrosine may also be synthesized from phenylalanine, in a reaction catalyzed by phenylalanine hydroxylase. Alanine, valine, and leucine are all biosynthetic products of pyruvate, the final product of glycolysis. Aspartate is formed from oxaloacetate, an intermediate of the citric acid cycle. Asparagine, methionine, threonine, and lysine are each produced by the conversion of aspartate. Isoleucine is formed from threonine. A complex 9-step pathway results in the production of histidine from 5-phosphoribosyl-1-pyrophosphate, an activated sugar.

Amino acids in excess of the protein synthesis needs of the cell cannot be stored, and are instead degraded to provide intermediates for the major metabolic pathways of the cell (for review see Stryer, L. Biochemistry $3^{rd}$ ed. Ch. 21 "Amino Acid Degradation and the Urea Cycle" p. 495-516 (1988)). Although the cell is able to convert unwanted amino acids into useful metabolic intermediates, amino acid production is costly in terms of energy, precursor molecules, and the enzymes necessary to synthesize them. Thus it is not surprising that amino acid biosynthesis is regulated by feedback inhibition, in which the presence of a particular amino acid serves to slow or entirely stop its own production (for overview of feedback mechanisms in amino acid biosynthetic pathways, see Stryer, L. Biochemistry, $3^{rd}$ ed. Ch. 24: "Biosynthesis of Amino Acids and Heme" p. 575-600 (1988)). Thus, the output of any particular amino acid is limited by the amount of that amino acid present in the cell.

B. Vitamin, Cofactor, and Nutraceutical Metabolism and Uses

Vitamins, cofactors, and nutraceuticals comprise another group of molecules which the higher animals have lost the ability to synthesize and so must ingest, although they are readily synthesized by other organisms such as bacteria. These molecules are either bioactive substances themselves, or are precursors of biologically active substances which may serve as electron carriers or intermediates in a variety of metabolic pathways. Aside from their nutritive value, these compounds also have significant industrial value as coloring agents, antioxidants, and catalysts or other processing aids. (For an overview of the structure, activity, and industrial applications of these compounds, see, for example, Ullman's Encyclopedia of Industrial Chemistry, "Vitamins" vol. A27, p. 443-613, VCH: Weinheim, 1996.) The term "vitamin" is art-recognized, and includes nutrients which are required by an organism for normal functioning, but which that organism cannot synthesize by itself. The group of vitamins may encompass cofactors and nutraceutical compounds. The language "cofactor" includes nonproteinaceous compounds required for a normal enzymatic activity to occur. Such compounds may be organic or inorganic; the cofactor molecules of the invention are preferably organic. The term "nutraceutical" includes dietary supplements having health benefits in plants and animals, particularly humans. Examples of such molecules are vitamins, antioxidants, and also certain lipids (e.g., polyunsaturated fatty acids).

The biosynthesis of these molecules in organisms capable of producing them, such as bacteria, has been largely characterized (Ullman's Encyclopedia of Industrial Chemistry, "Vitamins" vol. A27, p. 443-613, VCH: Weinheim, 1996; Michal, G. (1999) Biochemical Pathways: An Atlas of Biochemistry and Molecular Biology, John Wiley & Sons; Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1-3, 1994 at Penang, Malaysia, AOCS Press: Champaign, Ill. X, 374 S).

Thiamin (vitamin $B_1$) is produced by the chemical coupling of pyrimidine and thiazole moieties. Riboflavin (vitamin $B_2$) is synthesized from guanosine-5'-triphosphate (GTP) and ribose-5'-phosphate. Riboflavin, in turn, is utilized for the synthesis of flavin mononucleotide (FMN) and flavin adenine dinucleotide (FAD). The family of compounds collectively termed 'vitamin $B_6$' (e.g., pyridoxine, pyridoxamine, pyridoxa-5'-phosphate, and the commercially used pyridoxin hydrochloride) are all derivatives of the common structural unit, 5-hydroxy-6-methylpyridine. Pantothenate (pantothenic acid, (R)-(+)—N-(2,4-dihydroxy-3, 3-dimethyl-1-oxobutyl)-β-alanine) can be produced either by chemical synthesis or by fermentation. The final steps in pantothenate biosynthesis consist of the ATP-driven condensation of β-alanine and pantoic acid. The enzymes responsible for the biosynthesis steps for the conversion to pantoic acid, to β-alanine and for the condensation to panthotenic acid are known. The metabolically active form of pantothenate is Coenzyme A, for which the biosynthesis proceeds in 5 enzymatic steps. Pantothenate, pyridoxal-5'-phosphate, cysteine and ATP are the precursors of Coenzyme A. These enzymes not only catalyze the formation of panthothante, but also the production of (R)-pantoic acid, (R)-pantolacton, (R)-panthenol (provitamin $B_5$), pantetheine (and its derivatives) and coenzyme A.

Biotin biosynthesis from the precursor molecule pimeloyl-CoA in microorganisms has been studied in detail and several of the genes involved have been identified. Many of the corresponding proteins have been found to also be involved in Fe-cluster synthesis and are members of the nifS class of proteins. Lipoic acid is derived from octanoic acid, and serves as a coenzyme in energy metabolism, where it becomes part of the pyruvate dehydrogenase complex and the α-ketoglutarate dehydrogenase complex. The folates are a group of substances which are all derivatives of folic acid, which is turn is derived from L-glutamic acid, p-aminobenzoic acid and 6-methylpterin. The biosynthesis of folic acid and its derivatives, starting from the metabolism intermediates guanosine-5'-triphosphate (GTP), L-glutamic acid and p-amino-benzoic acid has been studied in detail in certain microorganisms.

Corrinoids (such as the cobalamines and particularly vitamin $B_{12}$) and porphyrines belong to a group of chemicals characterized by a tetrapyrole ring system. The biosynthesis of vitamin $B_{12}$ is sufficiently complex that it has not yet been completely characterized, but many of the enzymes and substrates involved are now known. Nicotinic acid (nicotinate), and nicotinamide are pyridine derivatives which are also termed 'niacin'. Niacin is the precursor of the important coenzymes AND (nicotinamide adenine dinucleotide) and NADP (nicotinamide adenine dinucleotide phosphate) and their reduced forms.

The large-scale production of these compounds has largely relied on cell-free chemical syntheses, though some of these chemicals have also been produced by large-scale culture of microorganisms, such as riboflavin, Vitamin $B_6$, pantothenate, and biotin. Only Vitamin $B_{12}$ is produced solely by fermentation, due to the complexity of its synthesis. In vitro methodologies require significant inputs of materials and time, often at great cost.

C. Purine, Pyrimidine, Nucleoside and Nucleotide Metabolism and Uses

Purine and pyrimidine metabolism genes and their corresponding proteins are important targets for the therapy of tumor diseases and viral infections. The language "purine" or "pyrimidine" includes the nitrogenous bases which are constituents of nucleic acids, co-enzymes, and nucleotides. The term "nucleotide" includes the basic structural units of nucleic acid molecules, which are comprised of a nitrogenous base, a pentose sugar (in the case of RNA, the sugar is ribose; in the case of DNA, the sugar is D-deoxyribose), and phosphoric acid. The language "nucleoside" includes molecules which serve as precursors to nucleotides, but which are lacking the phosphoric acid moiety that nucleotides possess. By inhibiting the biosynthesis of these molecules, or their mobilization to form nucleic acid molecules, it is possible to inhibit RNA and DNA synthesis; by inhibiting this activity in a fashion targeted to cancerous cells, the ability of tumor cells to divide and replicate may be inhibited. Additionally, there are nucleotides which do not form nucleic acid molecules, but rather serve as energy stores (i.e., AMP) or as coenzymes (i.e., FAD and AND).

Several publications have described the use of these chemicals for these medical indications, by influencing purine and/or pyrimidine metabolism (e.g. Christopherson, R. I. and Lyons, S. D. (1990) "Potent inhibitors of de novo pyrimidine and purine biosynthesis as chemotherapeutic agents." Med. Res. Reviews 10: 505-548). Studies of enzymes involved in purine and pyrimidine metabolism have been focused on the development of new drugs which can be used, for example, as immunosuppressants or antiproliferants (Smith, J. L., (1995) "Enzymes in nucleotide synthesis." Curr. Opin. Struct. Biol. 5: 752-757; (1995) Biochem Soc. Transact. 23: 877-902). However, purine and pyrimidine bases, nucleosides and nucleotides have other utilities: as intermediates in the biosynthesis of several fine chemicals (e.g., thiamine, S-adenosyl-methionine, folates, or riboflavin), as energy carriers for the cell (e.g., ATP or GTP), and for chemicals themselves, commonly used as flavor enhancers (e.g., IMP or GMP) or for several medicinal applications (see, for example, Kuninaka, A. (1996) Nucleotides and Related Compounds in Biotechnology vol. 6, Rehm et al., eds. VCH: Weinheim, p. 561-612). Also, enzymes involved in purine, pyrimidine, nucleoside, or nucleotide metabolism are increasingly serving as targets against which chemicals for crop protection, including fungicides, herbicides and insecticides, are developed.

The metabolism of these compounds in bacteria has been characterized (for reviews see, for example, Zalkin, H. and Dixon, J. E. (1992) "de novo purine nucleotide biosynthesis", in: Progress in Nucleic Acid Research and Molecular Biology, vol. 42, Academic Press:, p. 259-287; and Michal, G. (1999) "Nucleotides and Nucleosides", Chapter 8 in: Biochemical Pathways: An Atlas of Biochemistry and Molecular Biology, Wiley: New York). Purine metabolism has been the subject of intensive research, and is essential to the normal functioning of the cell. Impaired purine metabolism in higher animals can cause severe disease, such as gout. Purine nucleotides are synthesized from ribose-5-phosphate, in a series of steps through the intermediate compound inosine-5'-phosphate (IMP), resulting in the production of guanosine-5'-monophosphate (GMP) or adenosine-5'-monophosphate (AMP), from which the triphosphate forms utilized as nucleotides are readily formed. These compounds are also utilized as energy stores, so their degradation provides energy for many different biochemical processes in the cell. Pyrimidine biosynthesis proceeds by the formation of uridine-5'-monophosphate (UMP) from ribose-5-phosphate. UMP, in turn, is converted to cytidine-5'-triphosphate (CTP). The deoxy-forms of all of these nucleotides are produced in a one step reduction reaction from the diphosphate ribose form of the nucleotide to the diphosphate deoxyribose form of the nucleotide. Upon phosphorylation, these molecules are able to participate in DNA synthesis.

D. Trehalose Metabolism and Uses

Trehalose consists of two glucose molecules, bound in α, α-1,1 linkage. It is commonly used in the food industry as a sweetener, an additive for dried or frozen foods, and in beverages. However, it also has applications in the pharmaceutical, cosmetics and biotechnology industries (see, for example, Nishimoto et al., (1998) U.S. Pat. No. 5,759,610; Singer, M. A. and Lindquist, S. (1998) Trends Biotech. 16: 460-467; Paiva, C. L. A. and Panek, A. D. (1996) Biotech. Ann. Rev. 2: 293-314; and Shiosaka, M. (1997) J. Japan 172: 97-102). Trehalose is produced by enzymes from many microorganisms and is naturally released into the surrounding medium, from which it can be collected using methods known in the art.

II. Sugar and Carbon Molecule Utilization and Oxidative Phosphorylation

Carbon is a critically important element for the formation of all organic compounds, and thus is a nutritional requirement not only for the growth and division of C. glutamicum, but also for the overproduction of fine chemicals from this microorganism. Sugars, such as mono-, di-, or polysaccharides, are particularly good carbon sources, and thus standard growth media typically contain one or more of: glucose, fructose, mannose, galactose, ribose, sorbose, ribulose, lactose, maltose, sucrose, raffinose, starch, or cellulose (Ullmann's Encyclopedia of Industrial Chemistry (1987) vol. A9, "Enzymes", VCH: Weinheim). Alternatively, more complex forms of sugar may be utilized in the media, such as molasses, or other by-products of sugar refinement. Other compounds aside from the sugars may be used as alternate carbon sources, including alcohols (e.g., ethanol or methanol), alkanes, sugar alcohols, fatty acids, and organic acids (e.g., acetic acid or lactic acid). For a review of carbon sources and their utilization by microorganisms in culture, see: Ullman's Encyclopedia of Industrial Chemistry (1987) vol. A9, "Enzymes", VCH: Weinheim; Stoppok, E. and Buchholz, K. (1996) "Sugar-based raw materials for fermentation applications" in Biotechnology (Rehm, H. J. et al., eds.) vol. 6, VCH: Weinheim, p. 5-29; Rehm, H. J. (1980) Industrielle Mikrobiologie, Springer: Berlin; Bartholomew, W. H., and Reiman, H. B. (1979). Economics of Fermentation Processes, in: Peppler, H. J. and Perlman, D., eds. Microbial Technology $2^{nd}$ ed., vol. 2, chapter 18, Academic Press: New York; and Kockova-Kratachvilova, A. (1981) Characteristics of Industrial Microorganisms, in: Rehm, H. J. and Reed, G., eds. Handbook of Biotechnology, vol. 1, chapter 1, Verlag Chemie: Weinheim.

After uptake, these energy-rich carbon molecules must be processed such that they are able to be degraded by one of the major sugar metabolic pathways. Such pathways lead directly to useful degradation products, such as ribose-5-phosphate and phosphoenolpyruvate, which may be subsequently converted to pyruvate. Three of the most important pathways in bacteria for sugar metabolism include the Embden-Meyerhoff-Parnas (EMP) pathway (also known as the glycolytic or fructose bisphosphate pathway), the hexosemonophosphate (HMP) pathway (also known as the pentose shunt or pentose phosphate pathway), and the Entner-Doudoroff (ED) pathway (for review, see Michal, G. (1999) Biochemical Pathways: An Atlas of Biochemistry and Molecular Biology, Wiley: New York, and Stryer, L. (1988) Biochemistry, Chapters 13-19, Freeman: New York, and references therein).

The EMP pathway converts hexose molecules to pyruvate, and in the process produces 2 molecules of ATP and 2 molecules of NADH. Starting with glucose-1-phosphate (which may be either directly taken up from the medium, or alternatively may be generated from glycogen, starch, or cellulose), the glucose molecule is isomerized to fructose-6-phosphate, is phosphorylated, and split into two 3-carbon molecules of glyceraldehyde-3-phosphate. After dehydrogenation, phosphorylation, and successive rearrangements, pyruvate results.

The HMP pathway converts glucose to reducing equivalents, such as NADPH, and produces pentose and tetrose compounds which are necessary as intermediates and precursors in a number of other metabolic pathways. In the HMP pathway, glucose-6-phosphate is converted to ribulose-5-phosphate by two successive dehydrogenase reactions (which also release two NADPH molecules), and a carboxylation step. Ribulose-5-phosphate may also be converted to xyulose-5-phosphate and ribose-5-phosphate; the former can undergo a series of biochemical steps to glucose-6-phosphate, which may enter the EMP pathway, while the latter is commonly utilized as an intermediate in other biosynthetic pathways within the cell.

The ED pathway begins with the compound glucose or gluconate, which is subsequently phosphorylated and dehydrated to form 2-dehydro-3-deoxy-6-P-gluconate. Glucuronate and galacturonate may also be converted to 2-dehydro-3-deoxy-6-P-gluconate through more complex biochemical pathways. This product molecule is subsequently cleaved into glyceraldehyde-3-P and pyruvate; glyceraldehyde-3-P may itself also be converted to pyruvate.

The EMP and HMP pathways share many features, including intermediates and enzymes. The EMP pathway provides the greatest amount of ATP, but it does not produce ribose-5-phosphate, an important precursor for, e.g., nucleic acid biosynthesis, nor does it produce erythrose-4-phosphate, which is important for amino acid biosynthesis. Microorganisms that are capable of using only the EMP pathway for glucose utilization are thus not able to grow on simple media with glucose as the sole carbon source. They are referred to as fastidious organisms, and their growth requires inputs of complex organic compounds, such as those found in yeast extract.

In contrast, the HMP pathway produces all of the precursors necessary for both nucleic acid and amino acid biosynthesis, yet yields only half the amount of ATP energy that the EMP pathway does. The HMP pathway also produces NADPH, which may be used for redox reactions in biosynthetic pathways. The HMP pathway does not directly produce pyruvate, however, and thus these microorganisms must also possess this portion of the EMP pathway. It is therefore not surprising that a number of microorganisms, particularly the facultative anerobes, have evolved such that they possess both of these pathways.

The ED pathway has thus far has only been found in bacteria. Although this pathway is linked partly to the HMP pathway in the reverse direction for precursor formation, the ED pathway directly forms pyruvate by the aldolase cleavage of 3-ketodeoxy-6-phosphogluconate. The ED pathway can exist on its own and is utilized by the majority of strictly aerobic microorganisms. The net result is similar to that of the HMP pathway, although one mole of ATP can be formed only if the carbon atoms are converted into pyruvate, instead of into precursor molecules.

The pyruvate molecules produced through any of these pathways can be readily converted into energy via the Krebs cycle (also known as the citric acid cycle, the citrate cycle, or the tricarboxylic acid cycle (TCA cycle)). In this process, pyruvate is first decarboxylated, resulting in the production of one molecule of NADH, 1 molecule of acetyl-CoA, and 1 molecule of $CO_2$. The acetyl group of acetyl CoA then reacts with the 4 carbon unit, oxaolacetate, leading to the formation of citric acid, a 6 carbon organic acid. Dehydration and two additional $CO_2$ molecules are released. Ultimately, oxaloacetate is regenerated and can serve again as an acetyl acceptor, thus completing the cycle. The electrons released during the oxidation of intermediates in the TCA cycle are transferred to $AND^+$ to yield NADH.

During respiration, the electrons from NADH are transferred to molecular oxygen or other terminal electron acceptors. This process is catalyzed by the respiratory chain, an electron transport system containing both integral membrane proteins and membrane associated proteins. This system serves two basic functions: first, to accept electrons from an electron donor and to transfer them to an electron acceptor, and second, to conserve some of the energy released during electron transfer by the synthesis of ATP. Several types of oxidation-reduction enzymes and electron transport proteins are known to be involved in such processes, including the NADH dehydrogenases, flavin-containing electron carriers, iron sulfur proteins, and cytochromes. The NADH dehydrogenases are located at the cytoplasmic surface of the plasma membrane, and transfer hydrogen atoms from NADH to flavoproteins, in turn accepting electrons from NADH. The flavoproteins are a group of electron carriers possessing a flavin prosthetic group which is alternately reduced and oxidized as it accepts and transfers electrons. Three flavins are known to participate in these reactions: riboflavin, flavin-adenine dinucleotide (FAD) and flavin-mononucleotide (FMN). Iron sulfur proteins contain a cluster of iron and sulfur atoms which are not bonded to a heme group, but which still are able to participate in dehydration and rehydration reactions. Succinate dehydrogenase and aconitase are exemplary iron-sulfur proteins; their iron-sulfur complexes serve to accept and transfer electrons as part of the overall electron-transport chain. The cytochromes are proteins containing an iron porphyrin ring (heme). There are a number of different classes of cytochromes, differing in their reduction potentials. Functionally, these cytochromes form pathways in which electrons may be transferred to other cytochromes having increasingly more positive reduction potentials. A further class of non-protein electron carriers is known: the lipid-soluble quinones (e.g., coenzyme Q). These molecules also serve as hydrogen atom acceptors and electron donors.

The action of the respiratory chain generates a proton gradient across the cell membrane, resulting in proton motive force. This force is utilized by the cell to synthesize ATP, via the membrane-spanning enzyme, ATP synthase.

This enzyme is a multiprotein complex in which the transport of H+ molecules through the membrane results in the physical rotation of the intracellular subunits and concomitant phosphorylation of ADP to form ATP (for review, see Fillingame, R. H. and Divall, S. (1999) *Novartis Found. Symp.* 221: 218-229, 229-234).

Non-hexose carbon substrates may also serve as carbon and energy sources for cells. Such substrates may first be converted to hexose sugars in the gluconeogenesis pathway, where glucose is first synthesized by the cell and then is degraded to produce energy. The starting material for this reaction is phosphoenolpyruvate (PEP), which is one of the key intermediates in the glycolytic pathway. PEP may be formed from substrates other than sugars, such as acetic acid, or by decarboxylation of oxaloacetate (itself an intermediate in the TCA cycle). By reversing the glycolytic pathway (utilizing a cascade of enzymes different than those of the original glycolysis pathway), glucose-6-phosphate may be formed. The conversion of pyruvate to glucose requires the utilization of 6 high energy phosphate bonds, whereas glycolysis only produces 2 ATP in the conversion of glucose to pyruvate. However, the complete oxidation of glucose (glycolysis, conversion of pyruvate into acetyl CoA, citric acid cycle, and oxidative phosphorylation) yields between 36-38 ATP, so the net loss of high energy phosphate bonds experienced during gluconeogenesis is offset by the overall greater gain in such high-energy molecules produced by the oxidation of glucose.

III. Elements and Methods of the Invention

The present invention is based, at least in part, on the discovery of novel molecules, referred to herein as SMP nucleic acid and protein molecules, which participate in the conversion of sugars to useful degradation products and energy (e.g., ATP) in *C. glutamicum* or which may participate in the production of useful energy-rich molecules (e.g., ATP) by other processes, such as oxidative phosphorylation. In one embodiment, the SMP molecules participate in the metabolism of carbon compounds such as sugars or the generation of energy molecules (e.g., ATP) by processes such as oxidative phosphorylation in *Corynebacterium glutamicum*. In a preferred embodiment, the activity of the SMP molecules of the present invention to contribute to carbon metabolism or energy production in *C. glutamicum* has an impact on the production of a desired fine chemical by this organism. In a particularly preferred embodiment, the SMP molecules of the invention are modulated in activity, such that the *C. glutamicum* metabolic and energetic pathways in which the SMP proteins of the invention participate are modulated in yield, production, and/or efficiency of production, which either directly or indirectly modulates the yield, production, and/or efficiency of production of a desired fine chemical by *C. glutamicum*.

The language, "SMP protein" or "SMP polypeptide" includes proteins which are capable of performing a function involved in the metabolism of carbon compounds such as sugars and the generation of energy molecules by processes such as oxidative phosphorylation in *Corynebacterium glutamicum*. Examples of SMP proteins include those encoded by the SMP genes set forth in Table 1 and Appendix A. The terms "SMP gene" or "SMP nucleic acid sequence" include nucleic acid sequences encoding an SMP protein, which consist of a coding region and also corresponding untranslated 5' and 3' sequence regions. Examples of SMP genes include those set forth in Table 1. The terms "production" or "productivity" are art-recognized and include the concentration of the fermentation product (for example, the desired fine chemical) formed within a given time and a given fermentation volume (e.g., kg product per hour per liter). The term "efficiency of production" includes the time required for a particular level of production to be achieved (for example, how long it takes for the cell to attain a particular rate of output of a fine chemical). The term "yield" or "product/carbon yield" is art-recognized and includes the efficiency of the conversion of the carbon source into the product (i.e., fine chemical). This is generally written as, for example, kg product per kg carbon source. By increasing the yield or production of the compound, the quantity of recovered molecules, or of useful recovered molecules of that compound in a given amount of culture over a given amount of time is increased. The terms "biosynthesis" or a "biosynthetic pathway" are art-recognized and include the synthesis of a compound, preferably an organic compound, by a cell from intermediate compounds in what may be a multistep and highly regulated process. The terms "degradation" or a "degradation pathway" are art-recognized and include the breakdown of a compound, preferably an organic compound, by a cell to degradation products (generally speaking, smaller or less complex molecules) in what may be a multistep and highly regulated process. The term "degradation product" is art-recognized and includes breakdown products of a compound. Such products may themselves have utility as precursor (starting point) or intermediate molecules necessary for the biosynthesis of other compounds by the cell. The language "metabolism" is art-recognized and includes the totality of the biochemical reactions that take place in an organism. The metabolism of a particular compound, then, (e.g., the metabolism of an amino acid such as glycine) comprises the overall biosynthetic, modification, and degradation pathways in the cell related to this compound.

In another embodiment, the SMP molecules of the invention are capable of modulating the production of a desired molecule, such as a fine chemical, in a microorganism such as *C. glutamicum*. There are a number of mechanisms by which the alteration of an SMP protein of the invention may directly affect the yield, production, and/or efficiency of production of a fine chemical from a *C. glutamicum* strain incorporating such an altered protein. The degradation of high-energy carbon molecules such as sugars, and the conversion of compounds such as NADH and $FADH_2$ to more useful forms via oxidative phosphorylation results in a number of compounds which themselves may be desirable fine chemicals, such as pyruvate, ATP, NADH, and a number of intermediate sugar compounds. Further, the energy molecules (such as ATP) and the reducing equivalents (such as NADH or NADPH) produced by these metabolic pathways are utilized in the cell to drive reactions which would otherwise be energetically unfavorable. Such unfavorable reactions include many biosynthetic pathways for fine chemicals. By improving the ability of the cell to utilize a particular sugar (e.g., by manipulating the genes encoding enzymes involved in the degradation and conversion of that sugar into energy for the cell), one may increase the amount of energy available to permit unfavorable, yet desired metabolic reactions (e.g., the biosynthesis of a desired fine chemical) to occur.

The mutagenesis of one or more SMP genes of the invention may also result in SMP proteins having altered activities which indirectly impact the production of one or more desired fine chemicals from *C. glutamicum*. For example, by increasing the efficiency of utilization of one or more sugars (such that the conversion of the sugar to useful energy molecules is improved), or by increasing the efficiency of conversion of reducing equivalents to useful energy molecules (e.g., by improving the efficiency of oxidative phosphorylation, or the activity of the ATP synthase), one can increase the amount of these high-energy compounds available to the cell to drive normally unfavorable metabolic processes. These processes include the construction of cell walls, transcription, translation, and the biosynthesis of compounds necessary for growth and division of the cells (e.g., nucleotides, amino acids, vitamins, lipids, etc.) (Lengeler et al. (1999) Biology of Prokaryotes, Thieme Verlag: Stuttgart, p. 88-109; 913-918; 875-899). By improving the growth and multiplication of these engineered cells, it is possible to increase both the viability of the cells in large-scale culture, and also to improve their rate of division, such that a relatively larger number of cells can survive in fermentor culture. The yield, production, or efficiency of production may be increased, at least due to the presence of a greater number of viable cells, each producing the desired fine chemical. Further, a number of the degradation and intermediate compounds produced during sugar metabolism are necessary precursors and intermediates for other biosynthetic pathways throughout the cell. For example, many amino acids are synthesized directly from compounds normally resulting from glycolysis or the TCA cycle (e.g., serine is synthesized from 3-phosphoglycerate, an intermediate in glycolysis). Thus, by increasing the efficiency of conversion of sugars to useful energy molecules, it is also possible to increase the amount of useful degradation products as well.

The isolated nucleic acid sequences of the invention are contained within the genome of a Corynebacterium glutamicum strain available through the American Type Culture Collection, given designation ATCC 13032. The nucleotide sequence of the isolated C. glutamicum SMP DNAs and the predicted amino acid sequences of the C. glutamicum SMP proteins are shown in Appendices A and B, respectively. Computational analyses were performed which classified and/or identified these nucleotide sequences as sequences which encode proteins having a function involved in the metabolism of carbon compounds such as sugars or in the generation of energy molecules by processes such as oxidative phosphorylation in Corynebacterium glutamicum.

The present invention also pertains to proteins which have an amino acid sequence which is substantially homologous to an amino acid sequence of Appendix B. As used herein, a protein which has an amino acid sequence which is substantially homologous to a selected amino acid sequence is least about 50% homologous to the selected amino acid sequence, e.g., the entire selected amino acid sequence. A protein which has an amino acid sequence which is substantially homologous to a selected amino acid sequence can also be least about 50-60%, preferably at least about 60-70%, and more preferably at least about 70-80%, 80-90%, or 90-95%, and most preferably at least about 96%, 97%, 98%, 99% or more homologous to the selected amino acid sequence.

An SMP protein or a biologically active portion or fragment thereof of the invention can participate in the metabolism of carbon compounds such as sugars or in the generation of energy molecules (e.g., ATP) by processes such as oxidative phosphorylation in Corynebacterium glutamicum, or can have one or more of the activities set forth in Table 1.

Various aspects of the invention are described in further detail in the following subsections:

A. Isolated Nucleic Acid Molecules

One aspect of the invention pertains to isolated nucleic acid molecules that encode SMP polypeptides or biologically active portions thereof, as well as nucleic acid fragments sufficient for use as hybridization probes or primers for the identification or amplification of SMP-encoding nucleic acid (e.g., SMP DNA). As used herein, the term "nucleic acid molecule" is intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: at least about 100 nucleotides of sequence upstream from the 5' end of the coding region and at least about 20 nucleotides of sequence downstream from the 3' end of the coding region of the gene. The nucleic acid molecule can be single-stranded or double-stranded, but preferably is double-stranded DNA. An "isolated" nucleic acid molecule is one which is separated from other nucleic acid molecules which are present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated SMP nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived (e.g, a C. glutamicum cell). Moreover, an "isolated" nucleic acid molecule, such as a DNA molecule, can be substantially free of other cellular material, or culture medium when produced by recombinant techniques, or chemical precursors or other chemicals when chemically synthesized.

A nucleic acid molecule of the present invention, e.g., a nucleic acid molecule having a nucleotide sequence of Appendix A, or a portion thereof, can be isolated using standard molecular biology techniques and the sequence information provided herein. For example, a C. glutamicum SMP DNA can be isolated from a C. glutamicum library using all or portion of one of the sequences of Appendix A as a hybridization probe and standard hybridization techniques (e.g., as described in Sambrook, J., Fritsh, E. F., and Maniatis, T. Molecular Cloning: A Laboratory Manual. 2nd, ed., Cold Spring Harbor Laboratory, Cold Spring Harbor Laboratory Press, Cold Spring Harbor, N.Y., 1989). Moreover, a nucleic acid molecule encompassing all or a portion of one of the sequences of Appendix A can be isolated by the polymerase chain reaction using oligonucleotide primers designed based upon this sequence (e.g., a nucleic acid molecule encompassing all or a portion of one of the sequences of Appendix A can be isolated by the polymerase chain reaction using oligonucleotide primers designed based upon this same sequence of Appendix A). For example, mRNA can be isolated from normal endothelial cells (e.g., by the guanidinium-thiocyanate extraction procedure of Chirgwin et al. (1979) Biochemistry 18: 5294-5299) and DNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in Appendix A. A nucleic acid of the invention can be amplified using cDNA or, alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to an SMP nucleotide sequence can be prepared by standard synthetic techniques, e.g., using an automated DNA synthesizer.

In a preferred embodiment, an isolated nucleic acid molecule of the invention comprises one of the nucleotide sequences shown in Appendix A. The sequences of Appendix A correspond to the *Corynebacterium glutamicum* SMP DNAs of the invention. This DNA comprises sequences encoding SMP proteins (i.e., the "coding region", indicated in each sequence in Appendix A), as well as 5' untranslated sequences and 3' untranslated sequences, also indicated in Appendix A. Alternatively, the nucleic acid molecule can comprise only the coding region of any of the sequences in Appendix A.

For the purposes of this application, it will be understood that each of the sequences set forth in Appendix A has an identifying RXA, RXN, or RXS number having the designation "RXA," "RXN," or "RXS" followed by 5 digits (i.e., RXA00013, RXN0043, or RXS0735). Each of these sequences comprises up to three parts: a 5' upstream region, a coding region, and a downstream region. Each of these three regions is identified by the same RXA, RXN, or RXS designation to eliminate confusion. The recitation "one of the sequences in Appendix A", then, refers to any of the sequences in Appendix A, which may be distinguished by their differing RXA, RXN, or RXS designations. The coding region of each of these sequences is translated into a corresponding amino acid sequence, which is set forth in Appendix B. The sequences of Appendix B are identified by the same RXA, RXN, or RXS designations as Appendix A, such that they can be readily correlated. For example, the amino acid sequence in Appendix B designated RXA00013 is a translation of the coding region of the nucleotide sequence of nucleic acid molecule RXA00013 in Appendix A, and the amino acid sequence in Appendix B designated RXN0043 is a translation of the coding region of the nucleotide sequence of nucleic acid molecule RXN00043 in Appendix A. Each of the RXARXN and RXS nucleotide and amino acid sequences of the invention has also been assigned a SEQ ID NO, as indicated in Table 1.

Several of the genes of the invention are "F-designated genes". An F-designated gene includes those genes set forth in Table 1 which have an 'F' in front of the RXAdesignation. For example, SEQ ID NO:11, designated, as indicated on Table 1, as "F RXA01312", is an F-designated gene, as are SEQ ID NOs: 29, 33, and 39 (designated on Table 1 as "F RXA02803", "F RXA02854", and "F RXA01365", respectively).

In one embodiment, the nucleic acid molecules of the present invention are not intended to include those compiled in Table 2. In the case of the dapD gene, a sequence for this gene was published in Wehrmann, A., et al. (1998) *J. Bacteriol.* 180(12): 3159-3165. However, the sequence obtained by the inventors of the present application is significantly longer than the published version. It is believed that the published version relied on an incorrect start codon, and thus represents only a fragment of the actual coding region.

In another preferred embodiment, an isolated nucleic acid molecule of the invention comprises a nucleic acid molecule which is a complement of one of the nucleotide sequences shown in Appendix A, or a portion thereof. A nucleic acid molecule which is complementary to one of the nucleotide sequences shown in Appendix A is one which is sufficiently complementary to one of the nucleotide sequences shown in Appendix A such that it can hybridize to one of the nucleotide sequences shown in Appendix A, thereby forming a stable duplex.

In still another preferred embodiment, an isolated nucleic acid molecule of the invention comprises a nucleotide sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to a nucleotide sequence shown in Appendix A, or a portion thereof. Ranges and identity values intermediate to the above-recited ranges, (e.g., 70-90% identical or 80-95% identical) are also intended to be encompassed by the present invention. For example, ranges of identity values using a combination of any of the above values recited as upper and/or lower limits are intended to be included. In an additional preferred embodiment, an isolated nucleic acid molecule of the invention comprises a nucleotide sequence which hybridizes, e.g., hybridizes under stringent conditions, to one of the nucleotide sequences shown in Appendix A, or a portion thereof.

Moreover, the nucleic acid molecule of the invention can comprise only a portion of the coding region of one of the sequences in Appendix A, for example a fragment which can be used as a probe or primer or a fragment encoding a biologically active portion of an SMP protein. The nucleotide sequences determined from the cloning of the SMP genes from *C. glutamicum* allows for the generation of probes and primers designed for use in identifying and/or cloning SMP homologues in other cell types and organisms, as well as SMP homologues from other *Corynebacteria* or related species. The probe/primer typically comprises substantially purified oligonucleotide. The oligonucleotide typically comprises a region of nucleotide sequence that hybridizes under stringent conditions to at least about 12, preferably about 25, more preferably about 40, 50 or 75 consecutive nucleotides of a sense strand of one of the sequences set forth in Appendix A, an anti-sense sequence of one of the sequences set forth in Appendix A, or naturally occurring mutants thereof. Primers based on a nucleotide sequence of Appendix A can be used in PCR reactions to clone SMP homologues. Probes based on the SMP nucleotide sequences can be used to detect transcripts or genomic sequences encoding the same or homologous proteins. In preferred embodiments, the probe further comprises a label group attached thereto, e.g. the label group can be a radioisotope, a fluorescent compound, an enzyme, or an enzyme co-factor. Such probes can be used as a part of a diagnostic test kit for identifying cells which misexpress an SMP protein, such as by measuring a level of an SMP-encoding nucleic acid in a sample of cells, e.g., detecting SMP mRNA levels or determining whether a genomic SMP gene has been mutated or deleted.

In one embodiment, the nucleic acid molecule of the invention encodes a protein or portion thereof which includes an amino acid sequence which is sufficiently homologous to an amino acid sequence of Appendix B such that the protein or portion thereof maintains the ability to perform a function involved in the metabolism of carbon compounds such as sugars or in the generation of energy molecules (e.g., ATP) by processes such as oxidative phosphorylation in *Corynebacterium glutamicum*. As used herein, the language "sufficiently homologous" refers to proteins or portions thereof which have amino acid sequences which include a minimum number of identical or equivalent (e.g., an amino acid residue which has a similar side chain as an amino acid residue in one of the sequences of Appendix B) amino acid residues to an amino acid sequence of Appendix B such that the protein or portion thereof is able to perform a function involved in the metabolism of carbon compounds such as sugars or in the generation of energy molecules (e.g., ATP) by processes such as oxidative phosphorylation in *Corynebacterium glutamicum*. Protein members of such sugar metabolic pathways or energy producing systems, as described herein, may play a role in the production and secretion of one or more fine chemicals. Examples of such activities are also described herein. Thus, "the function of an SMP protein" contributes either directly or indirectly to the yield, production, and/or efficiency of production of one or more fine chemicals. Examples of SMP protein activities are set forth in Table 1.

In another embodiment, the protein is at least about 50-60%, preferably at least about 60-70%, and more preferably at least about 70-80%, 80-90%, 90-95%, and most preferably at least about 96%, 97%, 98%, 99% or more homologous to an entire amino acid sequence of Appendix B.

Portions of proteins encoded by the SMP nucleic acid molecules of the invention are preferably biologically active portions of one of the SMP proteins. As used herein, the term "biologically active portion of an SMP protein" is intended to include a portion, e.g., a domain/motif, of an SMP protein that participates in the metabolism of carbon compounds such as sugars, or in energy-generating pathways in *C. glutamicum*, or has an activity as set forth in Table 1. To determine whether an SMP protein or a biologically active portion thereof can participate in the metabolism of carbon compounds or in the production of energy-rich molecules in *C. glutamicum*, an assay of enzymatic activity may be performed. Such assay methods are well known to those of ordinary skill in the art, as detailed in Example 8 of the Exemplification.

Additional nucleic acid fragments encoding biologically active portions of an SMP protein can be prepared by isolating a portion of one of the sequences in Appendix B, expressing the encoded portion of the SMP protein or peptide (e.g., by recombinant expression in vitro) and assessing the activity of the encoded portion of the SMP protein or peptide.

The invention further encompasses nucleic acid molecules that differ from one of the nucleotide sequences shown in Appendix A (and portions thereof) due to degeneracy of the genetic code and thus encode the same SMP protein as that encoded by the nucleotide sequences shown in Appendix A. In another embodiment, an isolated nucleic acid molecule of the invention has a nucleotide sequence encoding a protein having an amino acid sequence shown in Appendix B. In a still further embodiment, the nucleic acid molecule of the invention encodes a full length *C. glutamicum* protein which is substantially homologous to an amino acid sequence of Appendix B (encoded by an open reading frame shown in Appendix A).

It will be understood by one of ordinary skill in the art that in one embodiment the sequences of the invention are not meant to include the sequences of the prior art, such as those Genbank sequences set forth in Tables 2 or 4 which were available prior to the present invention. In one embodiment, the invention includes nucleotide and amino acid sequences having a percent identity to a nucleotide or amino acid sequence of the invention which is greater than that of a sequence of the prior art (e.g., a Genbank sequence (or the protein encoded by such a sequence) set forth in Tables 2 or 4). For example, the invention includes a nucleotide sequence which is greater than and/or at least 58% identical to the nucleotide sequence designated RXA00014 (SEQ ID NO:41), a nucleotide sequence which is greater than and/or at least % identical to the nucleotide sequence designated RXA00195 (SEQ ID NO:399), and a nucleotide sequence which is greater than and/or at least 42% identical to the nucleotide sequence designated RXA00196 (SEQ ID NO:401). One of ordinary skill in the art would be able to calculate the lower threshold of percent identity for any given sequence of the invention by examining the GAP-calculated percent identity scores set forth in Table 4 for each of the three top hits for the given sequence, and by subtracting the highest GAP-calculated percent identity from 100 percent. One of ordinary skill in the art will also appreciate that nucleic acid and amino acid sequences having percent identities greater than the lower threshold so calculated (e.g., at least 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more identical) are also encompassed by the invention.

In addition to the *C. glutamicum* SMP nucleotide sequences shown in Appendix A, it will be appreciated by those of ordinary skill in the art that DNA sequence polymorphisms that lead to changes in the amino acid sequences of SMP proteins may exist within a population (e.g., the *C. glutamicum* population). Such genetic polymorphism in the SMP gene may exist among individuals within a population due to natural variation. As used herein, the terms "gene" and "recombinant gene" refer to nucleic acid molecules comprising an open reading frame encoding an SMP protein, preferably a *C. glutamicum* SMP protein. Such natural variations can typically result in 1-5% variance in the nucleotide sequence of the SMP gene. Any and all such nucleotide variations and resulting amino acid polymorphisms in SMP that are the result of natural variation and that do not alter the functional activity of SMP proteins are intended to be within the scope of the invention.

Nucleic acid molecules corresponding to natural variants and non-*C. glutamicum* homologues of the *C. glutamicum* SMP DNA of the invention can be isolated based on their homology to the *C. glutamicum* SMP nucleic acid disclosed herein using the *C. glutamicum* DNA, or a portion thereof, as a hybridization probe according to standard hybridization techniques under stringent hybridization conditions. Accordingly, in another embodiment, an isolated nucleic acid molecule of the invention is at least 15 nucleotides in length and hybridizes under stringent conditions to the nucleic acid molecule comprising a nucleotide sequence of Appendix A. In other embodiments, the nucleic acid is at least 30, 50, 100, 250 or more nucleotides in length. As used herein, the term "hybridizes under stringent conditions" is intended to describe conditions for hybridization and washing under which nucleotide sequences at least 60% homologous to each other typically remain hybridized to each other. Preferably, the conditions are such that sequences at least about 65%, more preferably at least about 70%, and even more preferably at least about 75% or more homologous to each other typically remain hybridized to each other. Such stringent conditions are known to those of ordinary skill in the art and can be found in *Current Protocols in Molecular*

*Biology*, John Wiley & Sons, N.Y. (1989), 6.3.1-6.3.6. A preferred, non-limiting example of stringent hybridization conditions are hybridization in 6× sodium chloride/sodium citrate (SSC) at about 45° C., followed by one or more washes in 0.2×SSC, 0.1% SDS at 50-65° C. Preferably, an isolated nucleic acid molecule of the invention that hybridizes under stringent conditions to a sequence of Appendix A corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein). In one embodiment, the nucleic acid encodes a natural *C. glutamicum* SMP protein.

In addition to naturally-occurring variants of the SMP sequence that may exist in the population, one of ordinary skill in the art will further appreciate that changes can be introduced by mutation into a nucleotide sequence of Appendix A, thereby leading to changes in the amino acid sequence of the encoded SMP protein, without altering the functional ability of the SMP protein. For example, nucleotide substitutions leading to amino acid substitutions at "non-essential" amino acid residues can be made in a sequence of Appendix A. A "non-essential" amino acid residue is a residue that can be altered from the wild-type sequence of one of the SMP proteins (Appendix B) without altering the activity of said SMP protein, whereas an "essential" amino acid residue is required for SMP protein activity. Other amino acid residues, however, (e.g., those that are not conserved or only semi-conserved in the domain having SMP activity) may not be essential for activity and thus are likely to be amenable to alteration without altering SMP activity.

Accordingly, another aspect of the invention pertains to nucleic acid molecules encoding SMP proteins that contain changes in amino acid residues that are not essential for SMP activity. Such SMP proteins differ in amino acid sequence from a sequence contained in Appendix B yet retain at least one of the SMP activities described herein. In one embodiment, the isolated nucleic acid molecule comprises a nucleotide sequence encoding a protein, wherein the protein comprises an amino acid sequence at least about 50% homologous to an amino acid sequence of Appendix B and is capable of participate in the metabolism of carbon compounds such as sugars, or in the biosynthesis of high-energy compounds in *C. glutamicum*, or has one or more activities set forth in Table 1. Preferably, the protein encoded by the nucleic acid molecule is at least about 50-60% homologous to one of the sequences in Appendix B, more preferably at least about 60-70% homologous to one of the sequences in Appendix B, even more preferably at least about 70-80%, 80-90%, 90-95% homologous to one of the sequences in Appendix B, and most preferably at least about 96%, 97%, 98%, or 99% homologous to one of the sequences in Appendix B.

To determine the percent homology of two amino acid sequences (e.g., one of the sequences of Appendix B and a mutant form thereof) or of two nucleic acids, the sequences are aligned for optimal comparison purposes (e.g., gaps can be introduced in the sequence of one protein or nucleic acid for optimal alignment with the other protein or nucleic acid). The amino acid residues or nucleotides at corresponding amino acid positions or nucleotide positions are then compared. When a position in one sequence (e.g., one of the sequences of Appendix B) is occupied by the same amino acid residue or nucleotide as the corresponding position in the other sequence (e.g., a mutant form of the sequence selected from Appendix B), then the molecules are homologous at that position (i.e., as used herein amino acid or nucleic acid "homology" is equivalent to amino acid or nucleic acid "identity"). The percent homology between the two sequences is a function of the number of identical positions shared by the sequences (i.e., % homology=# of identical positions/total # of positions×100).

An isolated nucleic acid molecule encoding an SMP protein homologous to a protein sequence of Appendix B can be created by introducing one or more nucleotide substitutions, additions or deletions into a nucleotide sequence of Appendix A such that one or more amino acid substitutions, additions or deletions are introduced into the encoded protein. Mutations can be introduced into one of the sequences of Appendix A by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted non-essential amino acid residue in an SMP protein is preferably replaced with another amino acid residue from the same side chain family. Alternatively, in another embodiment, mutations can be introduced randomly along all or part of an SMP coding sequence, such as by saturation mutagenesis, and the resultant mutants can be screened for an SMP activity described herein to identify mutants that retain SMP activity. Following mutagenesis of one of the sequences of Appendix A, the encoded protein can be expressed recombinantly and the activity of the protein can be determined using, for example, assays described herein (see Example 8 of the Exemplification).

In addition to the nucleic acid molecules encoding SMP proteins described above, another aspect of the invention pertains to isolated nucleic acid molecules which are antisense thereto. An "antisense" nucleic acid comprises a nucleotide sequence which is complementary to a "sense" nucleic acid encoding a protein, e.g., complementary to the coding strand of a double-stranded DNA molecule or complementary to an mRNA sequence. Accordingly, an antisense nucleic acid can hydrogen bond to a sense nucleic acid. The antisense nucleic acid can be complementary to an entire SMP coding strand, or to only a portion thereof. In one embodiment, an antisense nucleic acid molecule is antisense to a "coding region" of the coding strand of a nucleotide sequence encoding an SMP protein. The term "coding region" refers to the region of the nucleotide sequence comprising codons which are translated into amino acid residues (e.g., the entire coding region of NO. 3 (RXA01626) comprises nucleotides 1 to 345). In another embodiment, the antisense nucleic acid molecule is antisense to a "noncoding region" of the coding strand of a nucleotide sequence encoding SMP. The term "noncoding region" refers to 5' and 3' sequences which flank the coding region that are not translated into amino acids (i.e., also referred to as 5' and 3' untranslated regions).

Given the coding strand sequences encoding SMP disclosed herein (e.g., the sequences set forth in Appendix A), antisense nucleic acids of the invention can be designed according to the rules of Watson and Crick base pairing. The antisense nucleic acid molecule can be complementary to the entire coding region of SMP mRNA, but more preferably is an oligonucleotide which is antisense to only a portion of the coding or noncoding region of SMP mRNA. For example, the antisense oligonucleotide can be complementary to the region surrounding the translation start site of SMP mRNA. An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N-6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a cell or generated in situ such that they hybridize with or bind to cellular mRNA and/or genomic DNA encoding an SMP protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625-6641). The antisense nucleic acid molecule can also comprise a 2'-o-methylribonucleotide (Inoue et al. (1987) *Nucleic Acids Res.* 15:6131-6148) or a chimeric RNA-DNA analogue (Inoue et al. (1987) *FEBS Lett.* 215: 327-330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585-591)) can be used to catalytically cleave SMP mRNA transcripts to thereby inhibit translation of SMP mRNA. A ribozyme having specificity for an SMP-encoding nucleic acid can be designed based upon the nucleotide sequence of an SMP cDNA disclosed herein (i.e., SEQ ID NO. 3 (RXA01626) in Appendix A). For example, a derivative of a *Tetrahymena* L-19 IVS RNA can be constructed in which the nucleotide sequence of the active site is complementary to the nucleotide sequence to be cleaved in an SMP-encoding mRNA. See, e.g., Cech et al. U.S. Pat. No. 4,987,071 and Cech et al. U.S. Pat. No. 5,116,742. Alternatively, SMP mRNA can be used to select a catalytic RNA having a specific ribonuclease activity from a pool of RNA molecules. See, e.g., Bartel, D. and Szostak, J. W. (1993) *Science* 261:1411-1418.

Alternatively, SMP gene expression can be inhibited by targeting nucleotide sequences complementary to the regulatory region of an SMP nucleotide sequence (e.g., an SMP promoter and/or enhancers) to form triple helical structures that prevent transcription of an SMP gene in target cells. See generally, Helene, C. (1991) *Anticancer Drug Des.* 6(6): 569-84; Helene, C. et al. (1992) *Ann. N.Y. Acad. Sci.* 660:27-36; and Maher, L. J. (1992) *Bioassays* 14(12):807-15.

B. Recombinant Expression Vectors and Host Cells

Another aspect of the invention pertains to vectors, preferably expression vectors, containing a nucleic acid encoding an SMP protein (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel; *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells. Preferred regulatory sequences are, for example, promoters such as cos-, tac-, trp-, tet-, trp-tet-, lpp-, lac-, Ipp-lac-, $lac^q$-, T7-, T5-, T3-, gal-, trc-, ara-, SP6-, arny, $SPO_2$, $\lambda$-$P_R$- or $\lambda P_L$, which are used preferably in bacteria. Additional regulatory sequences are, for example, promoters from yeasts and fungi, such as ADC1, MFα, AC, P-60, CYC1, GAPDH, TEF, rp28, ADH, promoters from plants such as CaMV/35S, SSU, OCS, lib4, usp, STLS1, B33, nos or ubiquitin- or phaseolin-promoters. It is also possible to use artificial promoters. It will be appreciated by those of ordinary skill in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., SMP proteins, mutant forms of SMP proteins, fusion proteins, etc.).

The recombinant expression vectors of the invention can be designed for expression of SMP proteins in prokaryotic or eukaryotic cells. For example, SMP genes can be expressed in bacterial cells such as *C. glutamicum*, insect cells (using baculovirus expression vectors), yeast and other fungal cells (see Romanos, M. A. et al. (1992) "Foreign gene expression in yeast: a review", *Yeast* 8: 423-488; van den Hondel, C. A. M. J. J. et al. (1991) "Heterologous gene expression in filamentous fungi" in: More Gene Manipulations in Fungi, J. W. Bennet & L. L. Lasure, eds., p. 396-428: Academic Press: San Diego; and van den Hondel, C. A. M. J. J. & Punt, P. J. (1991) "Gene transfer systems and vector development for filamentous fungi, in: Applied Molecular Genetics of Fungi, Peberdy, J. F. et al., eds., p. 1-28, Cambridge University Press: Cambridge), algae and multi-cellular plant cells (see Schmidt, R. and Willmitzer, L. (1988) High efficiency *Agrobacterium tumefaciens*-mediated transformation of *Arabidopsis thaliana* leaf and cotyledon explants" *Plant Cell Rep:* 583-586), or mammalian cells. Suitable host cells are discussed further in Goeddel, *Gene Expression Technology: Methods in Enzymology* 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out with vectors containing constitutive or inducible promoters directing the expression of either fusion or non-fusion proteins. Fusion vectors add a number of amino acids to a protein encoded therein, usually to the amino terminus of the recombinant protein but also to the C-terminus or fused within suitable regions in the proteins. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith, D. B. and Johnson, K. S. (1988) *Gene* 67:31-40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. In one embodiment, the coding sequence of the SMP protein is cloned into a pGEX expression vector to create a vector encoding a fusion protein comprising, from the N-terminus to the C-terminus, GST-thrombin cleavage site-X protein. The fusion protein can be purified by affinity chromatography using glutathione-agarose resin. Recombinant SMP protein unfused to GST can be recovered by cleavage of the fusion protein with thrombin.

Examples of suitable inducible non-fusion *E. coli* expression vectors include pTrc (Amann et al., (1988) *Gene* 69:301-315), pLG338, pACYC184, pBR322, pUC18, pUC19, pKC30, pRep4, pHS1, pHS2, pPLc236, pMBL24, pLG200, pUR290, pIN-III113-B1, λgt11, pBdCI, and pET 11d (Studier et al., *Gene Expression Technology: Methods in Enzymology* 185, Academic Press, San Diego, Calif. (1990) 60-89; and Pouwels et al., eds. (1985) *Cloning Vectors. Elsevier: New York IBSN* 0 444 904018). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21 (DE3) or HMS 174(DE3) from a resident λ prophage harboring a T7 gn1 gene under the transcriptional control of the lacUV 5 promoter. For transformation of other varieties of bacteria, appropriate vectors may be selected. For example, the plasmids pIJ101, pIJ364, pIJ702 and pIJ361 are known to be useful in transforming *Streptomyces*, while plasmids pUB110, pC194, or pBD214 are suited for transformation of *Bacillus* species. Several plasmids of use in the transfer of genetic information into *Corynebacterium* include pHM1519, pBL1, pSA77, or pAJ667 (Pouwels et al., eds. (1985) *Cloning Vectors. Elsevier: New York IBSN* 0 444 904018).

One strategy to maximize recombinant protein expression is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119-128). Another strategy is to alter the nucleic acid sequence of the nucleic acid to be inserted into an expression vector so that the individual codons for each amino acid are those preferentially utilized in the bacterium chosen for expression, such as *C. glutamicum* (Wada et al. (1992) *Nucleic Acids Res.* 20:2111-2118). Such alteration of nucleic acid sequences of the invention can be carried out by standard DNA synthesis techniques.

In another embodiment, the SMP protein expression vector is a yeast expression vector. Examples of vectors for expression in yeast *S. cerevisiae* include pYepSec1 (Baldari, et al., (1987) *Embo J.* 6:229-234), 2μ, pAG-1, Yep6, Yepl3, pEMBLYe23, pMFa (Kurjan and Herskowitz, (1982) *Cell* 30:933-943), pJRY88 (Schultz et al., (1987) *Gene* 54:113-123), and pYES2 (Invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J. (1991) "Gene transfer systems and vector development for filamentous fungi, in: Applied Molecular Genetics of Fungi, J. F. Peberdy, et al., eds., p. 1-28, Cambridge University Press: Cambridge, and Pouwels et al., eds. (1985) Cloning Vectors. Elsevier: New York (IBSN 0 444 904018).

Alternatively, the SMP proteins of the invention can be expressed in insect cells using baculovirus expression vectors. Baculovirus vectors available for expression of proteins in cultured insect cells (e.g., Sf 9 cells) include the pAc series (Smith et al. (1983) *Mol. Cell. Biol.* 3:2156-2165) and the pVL series (Lucklow and Summers (1989) *Virology* 170:31-39).

In another embodiment, the SMP proteins of the invention may be expressed in unicellular plant cells (such as algae) or in plant cells from higher plants (e.g., the spermatophytes, such as crop plants). Examples of plant expression vectors include those detailed in: Becker, D., Kemper, E., Schell, J. and Masterson, R. (1992) "New plant binary vectors with selectable markers located proximal to the left border", *Plant Mol. Biol.* 20: 1195-1197; and Bevan, M. W. (1984) "Binary *Agrobacterium* vectors for plant transformation", Nucl. Acid. Res. 12: 8711-8721, and include pLGV23, pGHlac+, pBIN19, pAK2004, and pDH51 (Pouwels et al., eds. (1985) *Cloning Vectors. Elsevier: New York IBSN* 0 444 904018).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et al. (1987) *EMBO J.* 6:187-195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J., Fritsh, E. F., and Maniatis, T. *Molecular Cloning: A Laboratory Manual. 2nd, ed, Cold Spring Harbor Laboratory*, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et al. (1987) *Genes Dev.* 1:268-277), lymphoid-specific promoters (Calame and Eaton (1988) *Adv. Immunol.* 43:235-275), in particular promoters of T cell receptors (Winoto and Baltimore (1989) *EMBO J.* 8:729-733) and immunoglobulins (Banerji et al. (1983) *Cell* 33:729-740; Queen and Baltimore (1983) *Cell* 33:741-748), neuron-specific promoters (e.g., the neurofilament promoter; Byrne and Ruddle (1989) *PNAS* 86:5473-5477), pancreas-specific promoters (Edlund et al. (1985) *Science* 230:912-916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374-379) and the α-fetoprotein promoter (Campes and Tilghman (1989) *Genes Dev.* 3:537-546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to SMP mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see Weintraub, H. et al., Antisense RNA as a molecular tool for genetic analysis, *Reviews—Trends in Genetics*, Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, an SMP protein can be expressed in bacterial cells such as *C. glutamicum*, insect cells, yeast or mammalian cells (such as Chinese hamster ovary cells (CHO) or COS cells). Other suitable host cells are known to one of ordinary skill in the art. Microorganisms related to *Corynebacterium glutamicum* which may be conveniently used as host cells for the nucleic acid and protein molecules of the invention are set forth in Table 3.

Vector DNA can be introduced into prokaryotic or eukaryotic cells via conventional transformation or transfection techniques. As used herein, the terms "transformation" and "transfection", "conjugation" and "transduction" are intended to refer to a variety of art-recognized techniques for introducing foreign nucleic acid (e.g., linear DNA or RNA (e.g., a linearized vector or a gene construct alone without a vector) or nucleic acid in the form of a vector (e.g., a plasmid, phage, phasmid, phagemid, transposon or other DNA) into a host cell, including calcium phosphate or calcium chloride co-precipitation, DEAE-dextran-mediated transfection, lipofection, natural competence, chemical-mediated transfer, or electroporation. Suitable methods for transforming or transfecting host cells can be found in Sambrook, et al. (*Molecular Cloning: A Laboratory Manual. 2nd, ed, Cold Spring Harbor Laboratory*, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding an SMP protein or can be introduced on a separate vector. Cells stably transfected with the introduced nucleic acid can be identified by, for example, drug selection (e.g., cells that have incorporated the selectable marker gene will survive, while the other cells die).

To create a homologous recombinant microorganism, a vector is prepared which contains at least a portion of an SMP gene into which a deletion, addition or substitution has been introduced to thereby alter, e.g., functionally disrupt, the SMP gene. Preferably, this SMP gene is a *Corynebacterium glutamicum* SMP gene, but it can be a homologue from a related bacterium or even from a mammalian, yeast, or insect source. In a preferred embodiment, the vector is designed such that, upon homologous recombination, the endogenous SMP gene is functionally disrupted (i.e., no longer encodes a functional protein; also referred to as a "knock out" vector). Alternatively, the vector can be designed such that, upon homologous recombination, the endogenous SMP gene is mutated or otherwise altered but still encodes functional protein (e.g., the upstream regulatory region can be altered to thereby alter the expression of the endogenous SMP protein). In the homologous recombination vector, the altered portion of the SMP gene is flanked at its 5' and 3' ends by additional nucleic acid of the SMP gene to allow for homologous recombination to occur between the exogenous SMP gene carried by the vector and an endogenous SMP gene in a microorganism. The additional flanking SMP nucleic acid is of sufficient length for successful homologous recombination with the endogenous gene. Typically, several kilobases of flanking DNA (both at the 5' and 3' ends) are included in the vector (see e.g., Thomas, K. R., and Capecchi, M. R. (1987) *Cell* 51: 503 for a description of homologous recombination vectors). The vector is introduced into a microorganism (e.g., by electroporation) and cells in which the introduced SMP gene has homologously recombined with the endogenous SMP gene are selected, using art-known techniques.

In another embodiment, recombinant microorganisms can be produced which contain selected systems which allow for regulated expression of the introduced gene. For example, inclusion of an SMP gene on a vector placing it under control of the lac operon permits expression of the SMP gene only in the presence of IPTG. Such regulatory systems are well known in the art.

In another embodiment, an endogenous SMP gene in a host cell is disrupted (e.g., by homologous recombination or other genetic means known in the art) such that expression of its protein product does not occur. In another embodiment, an endogenous or introduced SMP gene in a host cell has been altered by one or more point mutations, deletions, or inversions, but still encodes a functional SMP protein. In still another embodiment, one or more of the regulatory regions (e.g., a promoter, repressor, or inducer) of an SMP gene in a microorganism has been altered (e.g., by deletion, truncation, inversion, or point mutation) such that the expression of the SMP gene is modulated. One of ordinary skill in the art will appreciate that host cells containing more than one of the described SMP gene and protein modifications may be readily produced using the methods of the invention, and are meant to be included in the present invention.

A host cell of the invention, such as a prokaryotic or eukaryotic host cell in culture, can be used to produce (i.e., express) an SMP protein. Accordingly, the invention further provides methods for producing SMP proteins using the host cells of the invention. In one embodiment, the method comprises culturing the host cell of invention (into which a recombinant expression vector encoding an SMP protein has been introduced, or into which genome has been introduced a gene encoding a wild-type or altered SMP protein) in a suitable medium until SMP protein is produced. In another embodiment, the method further comprises isolating SMP proteins from the medium or the host cell.

C. Isolated SMP Proteins

Another aspect of the invention pertains to isolated SMP proteins, and biologically active portions thereof. An "isolated" or "purified" protein or biologically active portion thereof is substantially free of cellular material when produced by recombinant DNA techniques, or chemical precursors or other chemicals when chemically synthesized. The language "substantially free of cellular material" includes preparations of SMP protein in which the protein is separated from cellular components of the cells in which it is naturally or recombinantly produced. In one embodiment, the language "substantially free of cellular material" includes preparations of SMP protein having less than about 30% (by dry weight) of non-SMP protein (also referred to herein as a "contaminating protein"), more preferably less than about 20% of non-SMP protein, still more preferably less than about 10% of non-SMP protein, and most preferably less than about 5% non-SMP protein. When the SMP protein or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations of SMP protein in which the protein is separated from chemical precursors or other chemicals which are involved in the synthesis of the protein. In one embodiment, the language "substantially free of chemical precursors or other chemicals" includes preparations of SMP protein having less than about 30% (by dry weight) of chemical precursors or non-SMP chemicals, more preferably less than about 20% chemical precursors or non-SMP chemicals, still more preferably less than about 10% chemical precursors or non-SMP chemicals, and most preferably less than about 5% chemical precursors or non-SMP chemicals. In preferred embodiments, isolated proteins or biologically active portions thereof lack contaminating proteins from the same organism from which the SMP protein is derived. Typically, such proteins are produced by recombinant expression of, for example, a *C. glutamicum* SMP protein in a microorganism such as *C. glutamicum*.

An isolated SMP protein or a portion thereof of the invention can participate in the metabolism of carbon compounds such as sugars, or in the production of energy compounds (e.g., by oxidative phosphorylation) utilized to drive unfavorable metabolic pathways, or has one or more of the activities set forth in Table 1. In preferred embodiments, the protein or portion thereof comprises an amino acid sequence which is sufficiently homologous to an amino acid sequence of Appendix B such that the protein or portion thereof maintains the ability to perform a function involved in the metabolism of carbon compounds such as sugars or in the generation of energy molecules by processes such as oxidative phosphorylation in *Corynebacterium glutamicum*. The portion of the protein is preferably a biologically active portion as described herein. In another preferred embodiment, an SMP protein of the invention has an amino acid sequence shown in Appendix B. In yet another preferred embodiment, the SMP protein has an amino acid sequence which is encoded by a nucleotide sequence which hybridizes, e.g., hybridizes under stringent conditions, to a nucleotide sequence of Appendix A. In still another preferred embodiment, the SMP protein has an amino acid sequence which is encoded by a nucleotide sequence that is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to one of the nucleic acid sequences of Appendix A, or a portion thereof. Ranges and identity values intermediate to the above-recited values, (e.g., 70-90% identical or 80-95% identical) are also intended to be encompassed by the present invention. For example, ranges of identity values using a combination of any of the above values recited as upper and/or lower limits are intended to be included. The preferred SMP proteins of the present invention also preferably possess at least one of the SMP activities described herein. For example, a preferred SMP protein of the present invention includes an amino acid sequence encoded by a nucleotide sequence which hybridizes, e.g., hybridizes under stringent conditions, to a nucleotide sequence of Appendix A, and which can perform a function involved in the metabolism of carbon compounds such as sugars or in the generation of energy molecules (e.g., ATP) by processes such as oxidative phosphorylation in *Corynebacterium glutamicum*, or which has one or more of the activities set forth in Table 1.

In other embodiments, the SMP protein is substantially homologous to an amino acid sequence of Appendix B and retains the functional activity of the protein of one of the sequences of Appendix B yet differs in amino acid sequence due to natural variation or mutagenesis, as described in detail in subsection I above. Accordingly, in another embodiment, the SMP protein is a protein which comprises an amino acid sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to an entire amino acid sequence of Appendix B and which has at least one of the SMP activities described herein. Ranges and identity values intermediate to the above-recited values, (e.g., 70-90% identical or 80-95% identical) are also intended to be encompassed by the present invention. For example, ranges of identity values using a combination of any of the above values recited as upper and/or lower limits are intended to be included. In another embodiment, the invention pertains to a full length *C. glutamicum* protein which is substantially homologous to an entire amino acid sequence of Appendix B.

Biologically active portions of an SMP protein include peptides comprising amino acid sequences derived from the amino acid sequence of an SMP protein, e.g., the an amino acid sequence shown in Appendix B or the amino acid sequence of a protein homologous to an SMP protein, which include fewer amino acids than a full length SMP protein or the full length protein which is homologous to an SMP protein, and exhibit at least one activity of an SMP protein. Typically, biologically active portions (peptides, e.g., peptides which are, for example, 5, 10, 15, 20, 30, 35, 36, 37, 38, 39, 40, 50, 100 or more amino acids in length) comprise a domain or motif with at least one activity of an SMP protein. Moreover, other biologically active portions, in which other regions of the protein are deleted, can be prepared by recombinant techniques and evaluated for one or more of the activities described herein. Preferably, the biologically active portions of an SMP protein include one or more selected domains/motifs or portions thereof having biological activity.

SMP proteins are preferably produced by recombinant DNA techniques. For example, a nucleic acid molecule encoding the protein is cloned into an expression vector (as described above), the expression vector is introduced into a host cell (as described above) and the SMP protein is expressed in the host cell. The SMP protein can then be isolated from the cells by an appropriate purification scheme using standard protein purification techniques. Alternative to recombinant expression, an SMP protein, polypeptide, or peptide can be synthesized chemically using standard peptide synthesis techniques. Moreover, native SMP protein can be isolated from cells (e.g., endothelial cells), for example using an anti-SMP antibody, which can be produced by standard techniques utilizing an SMP protein or fragment thereof of this invention.

The invention also provides SMP chimeric or fusion proteins. As used herein, an SMP "chimeric protein" or "fusion protein" comprises an SMP polypeptide operatively linked to a non-SMP polypeptide. An "SMP polypeptide" refers to a polypeptide having an amino acid sequence corresponding to an SMP protein, whereas a "non-SMP polypeptide" refers to a polypeptide having an amino acid sequence corresponding to a protein which is not substantially homologous to the SMP protein, e.g., a protein which is different from the SMP protein and which is derived from the same or a different organism. Within the fusion protein, the term "operatively linked" is intended to indicate that the SMP polypeptide and the non-SMP polypeptide are fused in-frame to each other. The non-SMP polypeptide can be fused to the N-terminus or C-terminus of the SMP polypeptide. For example, in one embodiment the fusion protein is a GST-SMP fusion protein in which the SMP sequences are fused to the C-terminus of the GST sequences. Such fusion proteins can facilitate the purification of recombinant SMP proteins. In another embodiment, the fusion protein is an SMP protein containing a heterologous signal sequence at its N-terminus. In certain host cells (e.g., mammalian host cells), expression and/or secretion of an SMP protein can be increased through use of a heterologous signal sequence.

Preferably, an SMP chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, *Current Protocols in Molecular Biology*, Ausubel et al., eds. John Wiley & Sons: 1992). Moreover, many expression vectors are commercially available that already encode a fusion moiety (e.g., a GST polypeptide). An SMP-encoding nucleic acid can be cloned into such an expression vector such that the fusion moiety is linked in-frame to the SMP protein.

Homologues of the SMP protein can be generated by mutagenesis, e.g., discrete point mutation or truncation of the SMP protein. As used herein, the term "homologue" refers to a variant form of the SMP protein which acts as an agonist or antagonist of the activity of the SMP protein. An agonist of the SMP protein can retain substantially the same, or a subset, of the biological activities of the SMP protein. An antagonist of the SMP protein can inhibit one or more of the activities of the naturally occurring form of the SMP protein, by, for example, competitively binding to a downstream or upstream member of the sugar molecule metabolic cascade or the energy-producing pathway which includes the SMP protein.

In an alternative embodiment, homologues of the SMP protein can be identified by screening combinatorial libraries of mutants, e.g., truncation mutants, of the SMP protein for SMP protein agonist or antagonist activity. In one embodiment, a variegated library of SMP variants is generated by combinatorial mutagenesis at the nucleic acid level and is encoded by a variegated gene library. A variegated library of SMP variants can be produced by, for example, enzymatically ligating a mixture of synthetic oligonucleotides into gene sequences such that a degenerate set of potential SMP sequences is expressible as individual polypeptides, or alternatively, as a set of larger fusion proteins (e.g., for phage display) containing the set of SMP sequences therein. There are a variety of methods which can be used to produce libraries of potential SMP homologues from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential SMP sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477).

In addition, libraries of fragments of the SMP protein coding can be used to generate a variegated population of SMP fragments for screening and subsequent selection of homologues of an SMP protein. In one embodiment, a library of coding sequence fragments can be generated by treating a double stranded PCR fragment of an SMP coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the SMP protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of SMP homologues. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique which enhances the frequency of functional mutants in the libraries, can be used in combination with the screening assays to identify SMP homologues (Arkin and Yourvan (1992) *PNAS* 89:7811-7815; Delgrave et al. (1993) *Protein Engineering* 6(3):327-331).

In another embodiment, cell based assays can be exploited to analyze a variegated SMP library, using methods well known in the art.

D. Uses and Methods of the Invention

The nucleic acid molecules, proteins, protein homologues, fusion proteins, primers, vectors, and host cells described herein can be used in one or more of the following methods: identification of *C. glutamicum* and related organisms; mapping of genomes of organisms related to *C. glutamicum*; identification and localization of *C. glutamicum* sequences of interest; evolutionary studies; determination of SMP protein regions required for function; modulation of an SMP protein activity; modulation of the metabolism of one or more sugars; modulation of high-energy molecule production in a cell (i.e., ATP, NADPH); and modulation of cellular production of a desired compound, such as a fine chemical.

The SMP nucleic acid molecules of the invention have a variety of uses. First, they may be used to identify an organism as being *Corynebacterium glutamicum* or a close relative thereof. Also, they may be used to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present. Although *Corynebacterium glutamicum* itself is nonpathogenic, it is related to pathogenic species, such as *Corynebacterium diphtheriae*. *Corynebacterium diphtheriae* is the causative agent of diphtheria, a rapidly developing, acute, febrile infection which involves both local and systemic pathology. In this disease, a local lesion develops in the upper respiratory tract and involves necrotic injury to epithelial cells;

the bacilli secrete toxin which is disseminated through this lesion to distal susceptible tissues of the body. Degenerative changes brought about by the inhibition of protein synthesis in these tissues, which include heart, muscle, peripheral nerves, adrenals, kidneys, liver and spleen, result in the systemic pathology of the disease. Diphtheria continues to have high incidence in many parts of the world, including Africa, Asia, Eastern Europe and the independent states of the former Soviet Union. An ongoing epidemic of diphtheria in the latter two regions has resulted in at least 5,000 deaths since 1990.

In one embodiment, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject. *C. glutamicum* and *C. diphtheriae* are related bacteria, and many of the nucleic acid and protein molecules in *C. glutamicum* are homologous to *C. diphtheriae* nucleic acid and protein molecules, and can therefore be used to detect *C. diphtheriae* in a subject.

The nucleic acid and protein molecules of the invention may also serve as markers for specific regions of the genome. This has utility not only in the mapping of the genome, but also for functional studies of *C. glutamicum* proteins. For example, to identify the region of the genome to which a particular *C. glutamicum* DNA-binding protein binds, the *C. glutamicum* genome could be digested, and the fragments incubated with the DNA-binding protein. Those which bind the protein may be additionally probed with the nucleic acid molecules of the invention, preferably with readily detectable labels; binding of such a nucleic acid molecule to the genome fragment enables the localization of the fragment on the genome map of *C. glutamicum*, and, when performed multiple times with different enzymes, facilitates a rapid determination of the nucleic acid sequence to which the protein binds. Further, the nucleic acid molecules of the invention may be sufficiently homologous to the sequences of related species such that these nucleic acid molecules may serve as markers for the construction of a genomic map in related bacteria, such as *Brevibacterium lactofermentum*.

The SMP nucleic acid molecules of the invention are also useful for evolutionary and protein structural studies. The metabolic and energy-releasing processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Manipulation of the SMP nucleic acid molecules of the invention may result in the production of SMP proteins having functional differences from the wild-type SMP proteins. These proteins may be improved in efficiency or activity, may be present in greater numbers in the cell than is usual, or may be decreased in efficiency or activity.

The invention provides methods for screening molecules which modulate the activity of an SMP protein, either by interacting with the protein itself or a substrate or binding partner of the SMP protein, or by modulating the transcription or translation of an SMP nucleic acid molecule of the invention. In such methods, a microorganism expressing one or more SMP proteins of the invention is contacted with one or more test compounds, and the effect of each test compound on the activity or level of expression of the SMP protein is assessed.

There are a number of mechanisms by which the alteration of an SMP protein of the invention may directly affect the yield, production, and/or efficiency of production of a fine chemical from a *C. glutamicum* strain incorporating such an altered protein. The degradation of high-energy carbon molecules such as sugars, and the conversion of compounds such as NADH and $FADH_2$ to more useful forms via oxidative phosphorylation results in a number of compounds which themselves may be desirable fine chemicals, such as pyruvate, ATP, NADH, and a number of intermediate sugar compounds. Further, the energy molecules (such as ATP) and the reducing equivalents (such as NADH or NADPH) produced by these metabolic pathways are utilized in the cell to drive reactions which would otherwise be energetically unfavorable. Such unfavorable reactions include many biosynthetic pathways for fine chemicals. By improving the ability of the cell to utilize a particular sugar (e.g., by manipulating the genes encoding enzymes involved in the degradation and conversion of that sugar into energy for the cell), one may increase the amount of energy available to permit unfavorable, yet desired metabolic reactions (e.g., the biosynthesis of a desired fine chemical) to occur.

Further, modulation of one or more pathways involved in sugar utilization permits optimization of the conversion of the energy contained within the sugar molecule to the production of one or more desired fine chemicals. For example, by reducing the activity of enzymes involved in, for example, gluconeogenesis, more ATP is available to drive desired biochemical reactions (such as fine chemical biosyntheses) in the cell. Also, the overall production of energy molecules from sugars may be modulated to ensure that the cell maximizes its energy production from each sugar molecule. Inefficient sugar utilization can lead to excess $CO_2$ production and excess energy, which may result in futile metabolic cycles. By improving the metabolism of sugar molecules, the cell should be able to function more efficiently, with a need for fewer carbon molecules. This should result in an improved fine chemical product: sugar molecule ratio (improved carbon yield), and permits a decrease in the amount of sugars that must be added to the medium in large-scale fermentor culture of such engineered *C. glutamicum*.

The mutagenesis of one or more SMP genes of the invention may also result in SMP proteins having altered activities which indirectly impact the production of one or more desired fine chemicals from *C. glutamicum*. For example, by increasing the efficiency of utilization of one or more sugars (such that the conversion of the sugar to useful energy molecules is improved), or by increasing the efficiency of conversion of reducing equivalents to useful energy molecules (e.g., by improving the efficiency of oxidative phosphorylation, or the activity of the ATP synthase), one can increase the amount of these high-energy compounds available to the cell to drive normally unfavorable metabolic processes. These processes include the construction of cell walls, transcription, translation, and the biosynthesis of compounds necessary for growth and division of the cells (e.g., nucleotides, amino acids, vitamins, lipids, etc.) (Lengeler et al. (1999) Biology of Prokaryotes, Thieme Verlag: Stuttgart, p. 88-109; 913-918; 875-899). By improving the growth and multiplication of these engineered cells, it is possible to increase both the viability of the cells in large-scale culture, and also to improve their rate of division, such that a relatively larger number of cells can survive in fermentor culture. The yield, production, or efficiency of production may be increased, at least due to the presence of a greater number of viable cells, each producing the desired fine chemical.

Further, many of the degradation products produced during sugar metabolism are themselves utilized by the cell as precursors or intermediates for the production of a number of other useful compounds, some of which are fine chemicals. For example, pyruvate is converted into the amino acid alanine, and ribose-5-phosphate is an integral part of, for example, nucleotide molecules. The amount and efficiency of sugar metabolism, then, has a profound effect on the availability of these degradation products in the cell. By increasing the ability of the cell to process sugars, either in terms of efficiency of existing pathways (e.g., by engineering enzymes involved in these pathways such that they are optimized in activity), or by increasing the availability of the enzymes involved in such pathways (e.g., by increasing the number of these enzymes present in the cell), it is possible to also increase the availability of these degradation products in the cell, which should in turn increase the production of many different other desirable compounds in the cell (e.g., fine chemicals).

The aforementioned mutagenesis strategies for SMP proteins to result in increased yields of a fine chemical from *C. glutamicum* are not meant to be limiting; variations on these strategies will be readily apparent to one of ordinary skill in the art. Using such strategies, and incorporating the mechanisms disclosed herein, the nucleic acid and protein molecules of the invention may be utilized to generate *C. glutamicum* or related strains of bacteria expressing mutated SMP nucleic acid and protein molecules such that the yield, production, and/or efficiency of production of a desired compound is improved. This desired compound may be any product produced by *C. glutamicum*, which includes the final products of biosynthesis pathways and intermediates of naturally-occurring metabolic pathways, as well as molecules which do not naturally occur in the metabolism of *C. glutamicum*, but which are produced by a *C. glutamicum* strain of the invention.

This invention is further illustrated by the following examples which should not be construed as limiting. The contents of all references, patent applications, patents, published patent applications, Tables, Appendices, and the sequence listing cited throughout this application are hereby incorporated by reference.

EXEMPLIFICATION

Example 1

Preparation of Total Genomic DNA of
Corynebacterium glutamicum ATCC 13032

A culture of *Corynebacterium glutamicum* (ATCC 13032) was grown overnight at 30° C. with vigorous shaking in BHI medium (Difco). The cells were harvested by centrifugation, the supernatant was discarded and the cells were resuspended in 5 ml buffer-I (5% of the original volume of the culture—all indicated volumes have been calculated for 100 ml of culture volume). Composition of buffer-I: 140.34 g/l sucrose, 2.46 g/l $MgSO_4 \times 7H_2O$, 10 ml/l $KH_2PO_4$ solution (100 g/l, adjusted to pH 6.7 with KOH), 50 ml/l M12 concentrate (10 g/l $(NH_4)_2SO_4$, 1 g/l NaCl, 2 g/l $MgSO_4 \times 7H_2O$, 0.2 g/l $CaCl_2$, 0.5 g/l yeast extract (Difco), 10 ml/l trace-elements-mix (200 mg/l $FeSO_4 \times H_2O$, 10 mg/l $ZnSO_4 \times 7H_2O$, 3 mg/l $MnCl_2 \times 4H_2O$, 30 mg/l $H_3BO_3$ 20 mg/l $CoCl_2 \times 6H_2O$, 1 mg/l $NiCl_2 \times 6H_2O$, 3 mg/l $Na_2MoO_4 \times 2H_2O$, 500 mg/l complexing agent (EDTA or critic acid), 100 ml/l vitamins-mix (0.2 mg/l biotin, 0.2 mg/l folic acid, 20 mg/l p-amino benzoic acid, 20 mg/l riboflavin, 40 mg/l ca-panthothenate, 140 mg/l nicotinic acid, 40 mg/l pyridoxole hydrochloride, 200 mg/l myo-inositol). Lysozyme was added to the suspension to a final concentration of 2.5 mg/ml. After an approximately 4 h incubation at 37° C., the cell wall was degraded and the resulting protoplasts are harvested by centrifugation. The pellet was washed once with 5 ml buffer-I and once with 5 ml TE-buffer (10 mM Tris-HCl, 1 mM EDTA, pH 8). The pellet was resuspended in 4 ml TE-buffer and 0.5 ml SDS solution (10%) and 0.5 ml NaCl solution (5 M) are added. After adding of proteinase K to a final concentration of 200 µg/ml, the suspension is incubated for ca. 18 h at 37° C. The DNA was purified by extraction with phenol, phenol-chloroform-isoamylalcohol and chloroform-isoamylalcohol using standard procedures. Then, the DNA was precipitated by adding 1/50 volume of 3 M sodium acetate and 2 volumes of ethanol, followed by a 30 min incubation at –20° C. and a 30 min centrifugation at 12,000 rpm in a high speed centrifuge using a SS34 rotor (Sorvall). The DNA was dissolved in 1 ml TE-buffer containing 20 µg/ml RNaseA and dialysed at 4° C. against 1000 ml TE-buffer for at least 3 hours. During this time, the buffer was exchanged 3 times. To aliquots of 0.4 ml of the dialysed DNA solution, 0.4 ml of 2 M LiCl and 0.8 ml of ethanol are added. After a 30 min incubation at –20° C., the DNA was collected by centrifugation (13,000 rpm, Biofuge Fresco, Heraeus, Hanau, Germany). The DNA pellet was dissolved in TE-buffer. DNA prepared by this procedure could be used for all purposes, including southern blotting or construction of genomic libraries.

Example 2

Construction of Genomic Libraries in *Escherichia coli* of *Corynebacterium glutamicum* ATCC13032

Using DNA prepared as described in Example 1, cosmid and plasmid libraries were constructed according to known and well established methods (see e.g., Sambrook, J. et al. (1989) "Molecular Cloning: A Laboratory Manual", Cold Spring Harbor Laboratory Press, or Ausubel, F. M. et al. (1994) "Current Protocols in Molecular Biology", John Wiley & Sons.)

Any plasmid or cosmid could be used. Of particular use were the plasmids pBR322 (Sutcliffe, J. G. (1979) *Proc. Natl. Acad. Sci. USA*, 75:3737-3741); pACYC177 (Change & Cohen (1978) *J. Bacteriol* 134:1141-1156), plasmids of the pBS series (pBSSK+, pBSSK– and others; Stratagene, LaJolla, USA), or cosmids as SuperCos1 (Stratagene, LaJolla, USA) or Lorist6 (Gibson, T. J., Rosenthal A. and Waterson, R. H. (1987) *Gene* 53:283-286. Gene libraries specifically for use in *C. glutamicum* may be constructed using plasmid pSL109 (Lee, H.-S. and A. J. Sinskey (1994) *J. Microbiol. Biotechnol.* 4: 256-263).

Example 3

DNA Sequencing and Computational Functional Analysis

Genomic libraries as described in Example 2 were used for DNA sequencing according to standard methods, in particular by the chain termination method using ABI377 sequencing machines (see e.g., Fleischman, R. D. et al. (1995) "Whole-genome Random Sequencing and Assembly of *Haemophilus Influenzae* Rd., *Science*, 269:496-512). Sequencing primers with the following nucleotide sequences were used: 5'-GGAAACAGTATGACCATG-3' (SEQ ID NO:783) or 5'-GTAAAACGACGGCCAGT-3' (SEQ ID NO:784).

Example 4

In Vivo Mutagenesis

In vivo mutagenesis of *Corynebacterium glutamicum* can be performed by passage of plasmid (or other vector) DNA through *E. coli* or other microorganisms (e.g. *Bacillus* spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D. (1996) DNA repair mechanisms, in: *Escherichia coli* and *Salmonella*, p. 2277-2294, ASM: Washington.) Such strains are well known to those of ordinary skill in the art. The use of such strains is illustrated, for example, in Greener, A. and Callahan, M. (1994) *Strategies* 7: 32-34.

Example 5

DNA Transfer Between *Escherichia coli* and *Corynebacterium glutamicum*

Several *Corynebacterium* and *Brevibacterium* species contain endogenous plasmids (as e.g., pHM1519 or pBL1) which replicate autonomously (for review see, e.g., Martin, J. F. et al. (1987) *Biotechnology*, 5:137-146). Shuttle vectors for *Escherichia coli* and *Corynebacterium glutamicum* can be readily constructed by using standard vectors for *E. coli* (Sambrook, J. et al. (1989), "Molecular Cloning: A Laboratory Manual", Cold Spring Harbor Laboratory Press or Ausubel, F. M. et al. (1994) "Current Protocols in Molecular Biology", John Wiley & Sons) to which a origin or replication for and a suitable marker from *Corynebacterium glutamicum* is added. Such origins of replication are preferably taken from endogenous plasmids isolated from *Corynebacterium* and *Brevibacterium* species. Of particular use as transformation markers for these species are genes for kanamycin resistance (such as those derived from the Tn5 or Tn903 transposons) or chloramphenicol (Winnacker, E. L. (1987) "From Genes to Clones—Introduction to Gene Technology", VCH, Weinheim). There are numerous examples in the literature of the construction of a wide variety of shuttle vectors which replicate in both *E. coli* and *C. glutamicum*, and which can be used for several purposes, including gene over-expression (for reference, see e.g., Yoshihama, M. et al. (1985) *J. Bacteriol.* 162:591-597, Martin J. F. et al. (1987) *Biotechnology*, 5:137-146 and Eikmanns, B. J. et al. (1991) *Gene*, 102:93-98).

Using standard methods, it is possible to clone a gene of interest into one of the shuttle vectors described above and to introduce such a hybrid vectors into strains of *Corynebacterium glutamicum*. Transformation of *C. glutamicum* can be achieved by protoplast transformation (Kastsumata, R. et al. (1984) *J. Bacteriol.* 159306-311), electroporation (Liebl, E. et al. (1989) *FEMS Microbiol. Letters,* 53:399-303) and in cases where special vectors are used, also by conjugation (as described e.g. in Schafer, A et al. (1990) *J. Bacteriol.* 172:1663-1666). It is also possible to transfer the shuttle vectors for *C. glutamicum* to *E. coli* by preparing plasmid DNA from *C. glutamicum* (using standard methods well-known in the art) and transforming it into *E. coli*. This transformation step can be performed using standard methods, but it is advantageous to use an Mcr-deficient *E. coli* strain, such as NM522 (Gough & Murray (1983) *J. Mol. Biol.* 166:1-19).

Genes may be overexpressed in *C. glutamicum* strains using plasmids which comprise pCG1 (U.S. Pat. No. 4,617, 267) or fragments thereof, and optionally the gene for kanamycin resistance from TN903 (Grindley, N. D. and Joyce, C. M. (1980) *Proc. Natl. Acad. Sci. USA* 77(12): 7176-7180). In addition, genes may be overexpressed in *C. glutamicum* strains using plasmid pSL 109 (Lee, H.-S. and A. J. Sinskey (1994) *J. Microbiol. Biotechnol.* 4: 256-263).

Aside from the use of replicative plasmids, gene overexpression can also be achieved by integration into the genome. Genomic integration in *C. glutamicum* or other *Corynebacterium* or *Brevibacterium* species may be accomplished by well-known methods, such as homologous recombination with genomic region(s), restriction endonuclease mediated integration (REMI) (see, e.g., DE Patent 19823834), or through the use of transposons. It is also possible to modulate the activity of a gene of interest by modifying the regulatory regions (e.g., a promoter, a repressor, and/or an enhancer) by sequence modification, insertion, or deletion using site-directed methods (such as homologous recombination) or methods based on random events (such as transposon mutagenesis or REMI). Nucleic acid sequences which function as transcriptional terminators may also be inserted 3' to the coding region of one or more genes of the invention; such terminators are well-known in the art and are described, for example, in Winnacker, E. L. (1987) From Genes to Clones—Introduction to Gene Technology. VCH: Weinheim.

Example 6

Assessment of the Expression of the Mutant Protein

Observations of the activity of a mutated protein in a transformed host cell rely on the fact that the mutant protein is expressed in a similar fashion and in a similar quantity to that of the wild-type protein. A useful method to ascertain the level of transcription of the mutant gene (an indicator of the amount of mRNA available for translation to the gene product) is to perform a Northern blot (for reference see, for example, Ausubel et al. (1988) Current Protocols in Molecular Biology, Wiley: New York), in which a primer designed to bind to the gene of interest is labeled with a detectable tag (usually radioactive or chemiluminescent), such that when the total RNA of a culture of the organism is extracted, run on gel, transferred to a stable matrix and incubated with this probe, the binding and quantity of binding of the probe indicates the presence and also the quantity of mRNA for this gene. This information is evidence of the degree of transcription of the mutant gene. Total cellular RNA can be prepared from *Corynebacterium glutamicum* by several methods, all well-known in the art, such as that described in Bormann, E. R. et al. (1992) *Mol. Microbiol.* 6: 317-326.

To assess the presence or relative quantity of protein translated from this mRNA, standard techniques, such as a Western blot, may be employed (see, for example, Ausubel et al. (1988) Current Protocols in Molecular Biology, Wiley: New York). In this process, total cellular proteins are extracted, separated by gel electrophoresis, transferred to a matrix such as nitrocellulose, and incubated with a probe, such as an antibody, which specifically binds to the desired protein. This probe is generally tagged with a chemiluminescent or colorimetric label which may be readily detected. The presence and quantity of label observed indicates the presence and quantity of the desired mutant protein present in the cell.

Example 7

Growth of Genetically Modified *Corynebacterium glutamicum*—Media and Culture Conditions Genetically modified *Corynebacteria* are cultured in synthetic or natural growth media. A number of different growth media for *Corynebacteria* are both well-known and readily available (Lieb et al. (1989) *Appl. Microbiol. Biotechnol.,* 32:205-210; von der Osten et al. (1998) *Biotechnology Letters,* 11:11-16; Patent DE 4,120,867; Liebl (1992) "The Genus *Corynebacterium,* in: The Procaryotes, Volume II, Balows, A. et al., eds. Springer-Verlag). These media consist of one or more carbon sources, nitrogen sources, inorganic salts, vitamins and trace elements. Preferred carbon sources are sugars, such as mono-, di-, or polysaccharides. For example, glucose, fructose, mannose, galactose, ribose, sorbose, ribulose, lactose, maltose, sucrose, raffinose, starch or cellulose serve as very good carbon sources. It is also possible to supply sugar to the media via complex compounds such as molasses or other by-products from sugar refinement. It can also be advantageous to supply mixtures of different carbon sources. Other possible carbon sources are alcohols and organic acids, such as methanol, ethanol, acetic acid or lactic acid. Nitrogen sources are usually organic or inorganic nitrogen compounds, or materials which contain these compounds. Exemplary nitrogen sources include ammonia gas or ammonia salts, such as $NH_4Cl$ or $(NH_4)_2SO_4$, $NH_4OH$, nitrates, urea, amino acids or complex nitrogen sources like corn steep liquor, soy bean flour, soy bean protein, yeast extract, meat extract and others.

Inorganic salt compounds which may be included in the media include the chloride-, phosphorous- or sulfate-salts of calcium, magnesium, sodium, cobalt, molybdenum, potassium, manganese, zinc, copper and iron. Chelating compounds can be added to the medium to keep the metal ions in solution. Particularly useful chelating compounds include dihydroxyphenols, like catechol or protocatechuate, or organic acids, such as citric acid. It is typical for the media to also contain other growth factors, such as vitamins or growth promoters, examples of which include biotin, riboflavin, thiamin, folic acid, nicotinic acid, pantothenate and pyridoxin. Growth factors and salts frequently originate from complex media components such as yeast extract, molasses, corn steep liquor and others. The exact composition of the media compounds depends strongly on the immediate experiment and is individually decided for each specific case. Information about media optimization is available in the textbook "Applied Microbiol. Physiology, A Practical Approach (eds. P. M. Rhodes, P. F. Stanbury, IRL Press (1997) pp. 53-73, ISBN 0 19 963577 3). It is also possible to select growth media from commercial suppliers, like standard 1 (Merck) or BHI (grain heart infusion, DIFCO) or others.

All medium components are sterilized, either by heat (20 minutes at 1.5 bar and 121° C.) or by sterile filtration. The components can either be sterilized together or, if necessary, separately. All media components can be present at the beginning of growth, or they can optionally be added continuously or batchwise.

Culture conditions are defined separately for each experiment. The temperature should be in a range between 15° C. and 45° C. The temperature can be kept constant or can be altered during the experiment. The pH of the medium should be in the range of 5 to 8.5, preferably around 7.0, and can be maintained by the addition of buffers to the media. An exemplary buffer for this purpose is a potassium phosphate buffer. Synthetic buffers such as MOPS, HEPES, ACES and others can alternatively or simultaneously be used. It is also possible to maintain a constant culture pH through the addition of NaOH or $NH_4OH$ during growth. If complex medium components such as yeast extract are utilized, the necessity for additional buffers may be reduced, due to the fact that many complex compounds have high buffer capacities. If a fermentor is utilized for culturing the microorganisms, the pH can also be controlled using gaseous ammonia.

The incubation time is usually in a range from several hours to several days. This time is selected in order to permit the maximal amount of product to accumulate in the broth. The disclosed growth experiments can be carried out in a variety of vessels, such as microtiter plates, glass tubes, glass flasks or glass or metal fermentors of different sizes. For screening a large number of clones, the microorganisms should be cultured in microtiter plates, glass tubes or shake flasks, either with or without baffles. Preferably 100 ml shake flasks are used, filled with 10% (by volume) of the required growth medium. The flasks should be shaken on a rotary shaker (amplitude 25 mm) using a speed-range of 100-300 rpm. Evaporation losses can be diminished by the maintenance of a humid atmosphere; alternatively, a mathematical correction for evaporation losses should be performed.

If genetically modified clones are tested, an unmodified control clone or a control clone containing the basic plasmid without any insert should also be tested. The medium is inoculated to an $OD_{600}$ of 0.5-1.5 using cells grown on agar plates, such as CM plates (10 g/l glucose, 2,5 g/l NaCl, 2 g/l urea, 10 g/l polypeptone, 5 g/l yeast extract, 5 g/l meat extract, 22 g/l NaCl, 2 g/l urea, 10 g/l polypeptone, 5 g/l yeast extract, 5 g/l meat extract, 22 g/l agar, pH 6.8 with 2M NaOH) that had been incubated at 30° C. Inoculation of the media is accomplished by either introduction of a saline suspension of *C. glutamicum* cells from CM plates or addition of a liquid preculture of this bacterium.

Example 8

In Vitro Analysis of the Function of Mutant Proteins

The determination of activities and kinetic parameters of enzymes is well established in the art. Experiments to determine the activity of any given altered enzyme must be tailored to the specific activity of the wild-type enzyme, which is well within the ability of one of ordinary skill in the art. Overviews about enzymes in general, as well as specific details concerning structure, kinetics, principles, methods, applications and examples for the determination of many enzyme activities may be found, for example, in the following references: Dixon, M., and Webb, E. C., (1979) Enzymes. Longmans: London; Fersht, (1985) Enzyme Structure and Mechanism. Freeman: New York; Walsh, (1979) Enzymatic Reaction Mechanisms. Freeman: San Francisco; Price, N. C., Stevens, L. (1982) Fundamentals of Enzymology. Oxford Univ. Press: Oxford; Boyer, P. D., ed. (1983) The Enzymes, 3 ed. Academic Press: New York; Bisswanger, H., (1994) Enzymkinetik, $2^{nd}$ ed. VCH: Weinheim (ISBN 3527300325); Bergmeyer, H. U., Bergmeyer, J., Graβ1, M., eds. (1983-1986) Methods of Enzymatic Analysis, $3^{rd}$ ed., vol. I-XII, Verlag Chemie: Weinheim; and Ullmann's Encyclopedia of Industrial Chemistry (1987) vol. A9, "Enzymes". VCH: Weinheim, p. 352-363.

The activity of proteins which bind to DNA can be measured by several well-established methods, such as DNA band-shift assays (also called gel retardation assays). The effect of such proteins on the expression of other molecules can be measured using reporter gene assays (such as that described in Kolmar, H. et al (1995) *EMBO J.* 14: 3895-3904 and references cited therein). Reporter gene test systems are well known and established for applications in both pro- and eukaryotic cells, using enzymes such as beta-galactosidase, green fluorescent protein, and several others.

The determination of activity of membrane-transport proteins can be performed according to techniques such as those described in Gennis, R. B. (1989) "Pores, Channels and Transporters", in Biomembranes, Molecular Structure and Function, Springer: Heidelberg, p. 85-137; 199-234; and 270-322.

Example 9

Analysis of Impact of Mutant Protein on the Production of the Desired Product

The effect of the genetic modification in *C. glutamicum* on production of a desired compound (such as an amino acid) can be assessed by growing the modified microorganism under suitable conditions (such as those described above) and analyzing the medium and/or the cellular component for increased production of the desired product (i.e., an amino acid). Such analysis techniques are well known to one of ordinary skill in the art, and include spectroscopy, thin layer chromatography, staining methods of various kinds, enzymatic and microbiological methods, and analytical chromatography such as high performance liquid chromatography (see, for example, Ullman, Encyclopedia of Industrial Chemistry, vol. A2, p. 89-90 and p. 443-613, VCH: Weinheim (1985); Fallon, A. et al., (1987) "Applications of HPLC in Biochemistry" in: Laboratory Techniques in Biochemistry and Molecular Biology, vol. 17; Rehm et al. (1993) Biotechnology, vol. 3, Chapter III: "Product recovery and purification", page 469-714, VCH: Weinheim; Belter, P. A. et al. (1988) Bioseparations: downstream processing for biotechnology, John Wiley and Sons; Kennedy, J. F. and Cabral, J. M. S. (1992) Recovery processes for biological materials, John Wiley and Sons; Shaeiwitz, J. A. and Henry, J. D. (1988) Biochemical separations, in: Ulmann's Encyclopedia of Industrial Chemistry, vol. B3, Chapter 11, page 1-27, VCH: Weinheim; and Dechow, F. J. (1989) Separation and purification techniques in biotechnology, Noyes Publications.)

In addition to the measurement of the final product of fermentation, it is also possible to analyze other components of the metabolic pathways utilized for the production of the desired compound, such as intermediates and side-products, to determine the overall efficiency of production of the compound. Analysis methods include measurements of nutrient levels in the medium (e.g., sugars, hydrocarbons, nitrogen sources, phosphate, and other ions), measurements of biomass composition and growth, analysis of the production of common metabolites of biosynthetic pathways, and measurement of gasses produced during fermentation. Standard methods for these measurements are outlined in Applied Microbial Physiology, A Practical Approach, P. M. Rhodes and P. F. Stanbury, eds., IRL Press, p. 103-129; 131-163; and 165-192 (ISBN: 0199635773) and references cited therein.

Example 10

Purification of the Desired Product from *C. glutamicum* Culture

Recovery of the desired product from the *C. glutamicum* cells or supernatant of the above-described culture can be performed by various methods well known in the art. If the desired product is not secreted from the cells, the cells can be harvested from the culture by low-speed centrifugation, the cells can be lysed by standard techniques, such as mechanical force or sonication. The cellular debris is removed by centrifugation, and the supernatant fraction containing the soluble proteins is retained for further purification of the desired compound. If the product is secreted from the *C. glutamicum* cells, then the cells are removed from the culture by low-speed centrifugation, and the supernate fraction is retained for further purification.

The supernatant fraction from either purification method is subjected to chromatography with a suitable resin, in which the desired molecule is either retained on a chromatography resin while many of the impurities in the sample are not, or where the impurities are retained by the resin while the sample is not. Such chromatography steps may be repeated as necessary, using the same or different chromatography resins. One of ordinary skill in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There are a wide array of purification methods known to the art and the preceding method of purification is not meant to be limiting. Such purification techniques are described, for example, in Bailey, J. E. & Ollis, D. F. Biochemical Engineering Fundamentals, McGraw-Hill: New York (1986).

The identity and purity of the isolated compounds may be assessed by techniques standard in the art. These include high-performance liquid chromatography (HPLC), spectroscopic methods, staining methods, thin layer chromatography, NIRS, enzymatic assay, or microbiologically. Such analysis methods are reviewed in: Patek et al. (1994) *Appl. Environ. Microbiol.* 60: 133-140; Malakhova et al. (1996) *Biotekhnologiya* 11: 27-32; and Schmidt et al. (1998) *Bioprocess Engineer.* 19: 67-70. Ulmann's Encyclopedia of Industrial Chemistry, (1996) vol. A27, VCH: Weinheim, p. 89-90, p. 521-540, p. 540-547, p. 559-566, 575-581 and p. 581-587; Michal, G. (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

Example 11

Analysis of the Gene Sequences of the Invention

The comparison of sequences and determination of percent homology between two sequences are art-known techniques, and can be accomplished using a mathematical algorithm, such as the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the NBLAST and XBLAST programs (version 2.0) of Altschul, et al. (1990) *J. Mol. Biol.* 215:403-10. BLAST nucleotide searches can be performed with the NBLAST program, score=100, wordlength=12 to obtain nucleotide sequences homologous to SMP nucleic acid molecules of the invention. BLAST protein searches can be performed with the XBLAST program, score=50, wordlength=3 to obtain amino acid sequences homologous to SMP protein molecules of the invention. To obtain gapped alignments for comparison purposes, Gapped BLAST can be utilized as described in Altschul et al., (1997) *Nucleic Acids Res.* 25(17):3389-3402. When utilizing BLAST and Gapped BLAST programs, one of ordinary skill in the art will know how to optimize the parameters of the program (e.g., XBLAST and NBLAST) for the specific sequence being analyzed.

Another example of a mathematical algorithm utilized for the comparison of sequences is the algorithm of Meyers and Miller ((1988) *Comput. Appl. Biosci.* 4: 11-17). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art, and include ADVANCE and ADAM. described in Torelli and Robotti (1994) *Comput. Appl. Biosci.* 10:3-5; and FASTA, described in Pearson and Lipman (1988) *P.N.A.S.* 85:2444-8.

The percent homology between two amino acid sequences can also be accomplished using the GAP program in the GCG software package (available at http://www.gcg.com), using either a Blosum 62 matrix or a PAM250 matrix, and a gap weight of 12, 10, 8, 6, or 4 and a length weight of 2, 3, or 4. The percent homology between two nucleic acid sequences can be accomplished using the GAP program in the GCG software package, using standard parameters, such as a gap weight of 50 and a length weight of 3.

A comparative analysis of the gene sequences of the invention with those present in Genbank has been performed using techniques known in the art (see, e.g., Bexevanis and Ouellette, eds. (1998) Bioinformatics: A Practical Guide to the Analysis of Genes and Proteins. John Wiley and Sons: New York). The gene sequences of the invention were compared to genes present in Genbank in a three-step process. In a first step, a BLASTN analysis (e.g., a local alignment analysis) was performed for each of the sequences of the invention against the nucleotide sequences present in Genbank, and the top 500 hits were retained for further analysis. A subsequent FASTA search (e.g., a combined local and global alignment analysis, in which limited regions of the sequences are aligned) was performed on these 500 hits. Each gene sequence of the invention was subsequently globally aligned to each of the top three FASTA hits, using the GAP program in the GCG software package (using standard parameters). In order to obtain correct results, the length of the sequences extracted from Genbank were adjusted to the length of the query sequences by methods well-known in the art. The results of this analysis are set forth in Table 4. The resulting data is identical to that which would have been obtained had a GAP (global) analysis alone been performed on each of the genes of the invention in comparison with each of the references in Genbank, but required significantly reduced computational time as compared to such a database-wide GAP (global) analysis. Sequences of the invention for which no alignments above the cutoff values were obtained are indicated on Table 4 by the absence of alignment information. It will further be understood by one of ordinary skill in the art that the GAP alignment homology percentages set forth in Table 4 under the heading "% homology (GAP)" are listed in the European numerical format, wherein a ',' represents a decimal point. For example, a value of "40,345" in this column represents "40.345%".

Example 12

Construction and Operation of DNA Microarrays

The sequences of the invention may additionally be used in the construction and application of DNA microarrays (the design, methodology, and uses of DNA arrays are well known in the art, and are described, for example, in Schena, M. et al. (1995) *Science* 270: 467-470; Wodicka, L. et al. (1997) *Nature Biotechnology* 15: 1359-1367; DeSaizieu, A. et al. (1998) *Nature Biotechnology* 16: 45-48; and DeRisi, J. L. et al. (1997) *Science* 278: 680-686).

DNA microarrays are solid or flexible supports consisting of nitrocellulose, nylon, glass, silicone, or other materials. Nucleic acid molecules may be attached to the surface in an ordered manner. After appropriate labeling, other nucleic acids or nucleic acid mixtures can be hybridized to the immobilized nucleic acid molecules, and the label may be used to monitor and measure the individual signal intensities of the hybridized molecules at defined regions. This methodology allows the simultaneous quantification of the relative or absolute amount of all or selected nucleic acids in the applied nucleic acid sample or mixture. DNA microarrays, therefore, permit an analysis of the expression of multiple (as many as 6800 or more) nucleic acids in parallel (see, e.g., Schena, M. (1996) *BioEssays* 18(5): 427-431).

The sequences of the invention may be used to design oligonucleotide primers which are able to amplify defined regions of one or more *C. glutamicum* genes by a nucleic acid amplification reaction such as the polymerase chain reaction. The choice and design of the 5' or 3' oligonucleotide primers or of appropriate linkers allows the covalent attachment of the resulting PCR products to the surface of a support medium described above (and also described, for example, Schena, M. et al. (1995) *Science* 270: 467-470).

Nucleic acid microarrays may also be constructed by in situ oligonucleotide synthesis as described by Wodicka, L. et al. (1997) *Nature Biotechnology* 15: 1359-1367. By photolithographic methods, precisely defined regions of the matrix are exposed to light. Protective groups which are photolabile are thereby activated and undergo nucleotide addition, whereas regions that are masked from light do not undergo any modification. Subsequent cycles of protection and light activation permit the synthesis of different oligonucleotides at defined positions. Small, defined regions of the genes of the invention may be synthesized on microarrays by solid phase oligonucleotide synthesis.

The nucleic acid molecules of the invention present in a sample or mixture of nucleotides may be hybridized to the microarrays. These nucleic acid molecules can be labeled according to standard methods. In brief, nucleic acid molecules (e.g., mRNA molecules or DNA molecules) are labeled by the incorporation of isotopically or fluorescently labeled nucleotides, e.g., during reverse transcription or DNA synthesis. Hybridization of labeled nucleic acids to microarrays is described (e.g., in Schena, M. et al. (1995) supra; Wodicka, L. et al. (1997), supra; and DeSaizieu A. et al. (1998), supra). The detection and quantification of the hybridized molecule are tailored to the specific incorporated label. Radioactive labels can be detected, for example, as described in Schena, M. et al. (1995) supra) and fluorescent labels may be detected, for example, by the method of Shalon et al. (1996) *Genome Research* 6: 639-645).

The application of the sequences of the invention to DNA microarray technology, as described above, permits comparative analyses of different strains of *C. glutamicum* or other *Corynebacteria*. For example, studies of inter-strain variations based on individual transcript profiles and the identification of genes that are important for specific and/or desired strain properties such as pathogenicity, productivity and stress tolerance are facilitated by nucleic acid array methodologies. Also, comparisons of the profile of expression of genes of the invention during the course of a fermentation reaction are possible using nucleic acid array technology.

Example 13

Analysis of the Dynamics of Cellular Protein Populations (Proteomics)

The genes, compositions, and methods of the invention may be applied to study the interactions and dynamics of populations of proteins, termed 'proteomics'. Protein populations of interest include, but are not limited to, the total protein population of *C. glutamicum* (e.g., in comparison with the protein populations of other organisms), those proteins which are active under specific environmental or metabolic conditions (e.g., during fermentation, at high or low temperature, or at high or low pH), or those proteins which are active during specific phases of growth and development.

Protein populations can be analyzed by various well-known techniques, such as gel electrophoresis. Cellular proteins may be obtained, for example, by lysis or extraction, and may be separated from one another using a variety of electrophoretic techniques. Sodium dodecyl sulfate polyacrylamide gel electrophoresis (SDS-PAGE) separates proteins largely on the basis of their molecular weight. Isoelectric focusing polyacrylamide gel electrophoresis (IEF-PAGE) separates proteins by their isoelectric point (which reflects not only the amino acid sequence but also posttranslational modifications of the protein). Another, more preferred method of protein analysis is the consecutive combination of both IEF-PAGE and SDS-PAGE, known as 2-D gel electrophoresis (described, for example, in Hermann et al. (1998) *Electrophoresis* 19: 3217-3221; Fountoulakis et al. (1998) *Electrophoresis* 19: 1193-1202; Langen et al. (1997) *Electrophoresis* 18: 1184-1192; Antelmann et al. (1997) *Electrophoresis* 18: 1451-1463). Other separation techniques may also be utilized for protein separation, such as capillary gel electrophoresis; such techniques are well known in the art.

Proteins separated by these methodologies can be visualized by standard techniques, such as by staining or labeling. Suitable stains are known in the art, and include Coomassie Brilliant Blue, silver stain, or fluorescent dyes such as Sypro Ruby (Molecular Probes). The inclusion of radioactively labeled amino acids or other protein precursors (e.g., $^{35}$S-methionine, $^{35}$S-cysteine, $^{14}$C-labelled amino acids, $^{15}$N-amino acids, $^{15}$NO$_3$ or $^{15}$NH$_4^+$ or $^{13}$C-labelled amino acids) in the medium of *C. glutamicum* permits the labeling of proteins from these cells prior to their separation. Similarly, fluorescent labels may be employed. These labeled proteins can be extracted, isolated and separated according to the previously described techniques.

Proteins visualized by these techniques can be further analyzed by measuring the amount of dye or label used. The amount of a given protein can be determined quantitatively using, for example, optical methods and can be compared to the amount of other proteins in the same gel or in other gels. Comparisons of proteins on gels can be made, for example, by optical comparison, by spectroscopy, by image scanning and analysis of gels, or through the use of photographic films and screens. Such techniques are well-known in the art.

To determine the identity of any given protein, direct sequencing or other standard techniques may be employed. For example, N- and/or C-terminal amino acid sequencing (such as Edman degradation) may be used, as may mass spectrometry (in particular MALDI or ESI techniques (see, e.g., Langen et al. (1997) *Electrophoresis* 18: 1184-1192)). The protein sequences provided herein can be used for the identification of *C. glutamicum* proteins by these techniques.

The information obtained by these methods can be used to compare patterns of protein presence, activity, or modification between different samples from various biological conditions (e.g., different organisms, time points of fermentation, media conditions, or different biotopes, among others). Data obtained from such experiments alone, or in combination with other techniques, can be used for various applications, such as to compare the behavior of various organisms in a given (e.g., metabolic) situation, to increase the productivity of strains which produce fine chemicals or to increase the efficiency of the production of fine chemicals.

EQUIVALENTS

Those of ordinary skill in the art will recognize, or will be able to ascertain using no more than routine experimentation, many equivalents to the specific embodiments of the invention described herein. Such equivalents are intended to be encompassed by the following claims.

TABLE 1

GENES IN THE APPLICATION

| Nucleic Acid SEQ ID NO | Amino Acid SEQ ID NO | Identification Code | Config | NT Start | NT Stop | Function |
|---|---|---|---|---|---|---|
| | | | | | | HMP: |
| 1 | 2 | RSX02735 | W0074 | 14576 | 15280 | 6-Phosphogluconolactonase |
| 3 | 4 | RxA01626 | GR00452 | 4270 | 3926 | L-ribulose-phosphate 4-epimerase |
| 5 | 6 | RXA02245 | GR00554 | 13639 | 14295 | RIBULOSE-PHOSPHATE 3-EPIMERASE (EC 5 1 3 1) |
| 7 | 8 | RXA01015 | GR00290 | 346 | 5 | RIBOSE 5-PHOSPHATE ISOMERASE (EC 5.3.1.6) |
| | | | | | | TCA: |
| 9 | 10 | RXN01312 | W0062 | 20803 | 18765 | SUCCINATE DEHYDROGENASE FLAVOPROTEIN SUBUNIT (EC 1 3 99 1) |
| 11 | 12 | FRXAD1312 | GR00380 | 2690 | 1614 | SUCCINATE DEHYDROGENASE FLAVOPROTEIN SUBUNIT (EC 1 3 99 1) |
| 13 | 14 | RXN00231 | W0083 | 15484 | 14015 | SUCCINATE-SEMALDEHYDE DEHYDROGENASE (NADP$^+$) (EC 1.2.1.16) |
| 15 | 16 | RXA01311 | GR00380 | 1511 | 865 | SUCCINATE DEHYDROGENASE IRON-SULFUR-PROTEIN (EC 1.3.99.1) |
| 17 | 18 | RXA01535 | GR00427 | 1354 | 2760 | FUMARATE HYDRATASE PRECURSOR (EC 42.12) |
| 19 | 20 | RXA00517 | GR00131 | 1407 | 2447 | MALATE DEHYDROGENASE (EC 1.1.137) (EC 1.1.1.82) |
| 21 | 22 | RXA01350 | GR00392 | 1844 | 2827 | MALATE DEHYDROGENASE (EC 1.1.137) |
| | | | | | | EMB-Pathway |
| 23 | 24 | RXA02149 | GR00639 | 17786 | 18754 | GLUCOKINASE (EC 2.7.1.2) |
| 25 | 26 | RXA01814 | GR00515 | 2571 | 910 | PHOSPHOGLUCOMUTASE (EC 5.4.2.2)/PHOSPHOMANNOMUTASE (EC 5.4.2.8) |
| 27 | 28 | RXN02803 | W0086 | 1 | 557 | PHOSPHOGLUCOMUTASE (EC 5.4.2.2)/PHOSPHOMANNOMUTASE (EC 5.4.2.8) |
| 29 | 30 | FRXA02803 | GR00784 | 2 | 400 | PHOSPHOGLUCOMUTASE (EC 5.4.2.2)/PHOSPHOMANNOMUTASE (EC 5.4.2.8) |
| 31 | 32 | RXN03076 | W0043 | 1624 | 35 | PHOSPHOGLUCOMUTASE (EC 5.4.2.2)/PHOSPHOMANNOMUTASE (EC 5.4.2.8) |
| 33 | 34 | FRXA02854 | GR10002 | 1588 | 5 | PHOSPHOGLUCOMUTASE (EC 5.4.2.2)/PHOSPHOMANNOMUTASE (EC 5.4.2.8) |
| 35 | 36 | RXA00511 | GR00128 | 1 | 513 | PHOSPHOGLUCOMUTASE (EC 5.4.2.2)/PHOSPHOMANNOMUTASE (EC 5.4.2.8) |

| Nucleic Acid SEQ ID NO | Amino Acid SEQ ID NO | Identification Code | Contig. | NT Start | NT Stop | Function |
|---|---|---|---|---|---|---|
| 37 | 38 | RXN01365 | VV0091 | 1476 | 103 | PHOSPHOGLUCOMUTASE (EC 5.4.2.2)/PHOSPHOMANNOMUTASE (EC 5.4.2.8) |
| 39 | 40 | F RXA01365 | GR00397 | 897 | 4 | PHOSPHOGLUCOMUTASE (EC 5.4.2.2)/PHOSPHOMANNOMUTASE (EC 5.4.2.8) |
| 41 | 42 | RXA00098 | GR00014 | 6525 | 8144 | GLUCOSE-6-PHOSPHATE ISOMERASE (GPI) (EC 5.3.1.9) |
| 43 | 44 | RXA01989 | GR00578 | 1 | 630 | GLUCOSE-6-PHOSPHATE ISOMERASE A (GPI A) (EC 5.3.1.9) |
| 45 | 46 | RXA00340 | GR00059 | 1549 | 2694 | PHOSPHOGLYCERATE MUTASE (EC 5.4.2.1) |
| 47 | 48 | RXA02492 | GR00720 | 2201 | 2917 | PHOSPHOGLYCERATE MUTASE (EC 5.4.2.1) |
| 49 | 50 | RXA00381 | GR00082 | 1451 | 846 | PHOSPHOGLYCERATE MUTASE (EC 5.4.2.1) |
| 51 | 52 | RXA02122 | GR00636 | 6511 | 5813 | PHOSPHOGLYCERATE MUTASE (EC 5.4.2.1) |
| 53 | 54 | RXA00206 | GR00032 | 6171 | 5134 | 6-PHOSPHOFRUCTOKINASE (EC 2.7.1.11) |
| 55 | 56 | RXA01243 | GR00359 | 2302 | 3261 | 1-PHOSPHOFRUCTOKINASE (EC 2.7.1.56) |
| 57 | 58 | RXA01882 | GR00538 | 1165 | 2154 | 1-PHOSPHOFRUCTOKINASE (EC 2.7.1.56) |
| 59 | 60 | RXA01702 | GR00479 | 1397 | 366 | FRUCTOSE-BISPHOSPHATE ALDOLASE (EC 4.1.2.13) |
| 61 | 62 | RXA02258 | GR00654 | 26451 | 27227 | TRIOSEPHOSPHATE ISOMERASE (EC 5.3.1.1) |
| 63 | 64 | RXN01225 | VV0064 | 6382 | 4943 | GLYCERALDEHYDE 3-PHOSPHATE DEHYDROGENASE (EC 1.2.1.12) |
| 65 | 66 | F RXA01225 | GR00354 | 5302 | 6741 | GLYCERALDEHYDE-3-PHOSPHATE DEHYDROGENASE HOMOLOG |
| 67 | 68 | RXA02256 | GR00654 | 23934 | 24935 | GLYCERALDEHYDE-3-PHOSPHATE DEHYDROGENASE (EC 1.2.1.12) |
| 69 | 70 | RXA02257 | GR00654 | 25155 | 26369 | PHOSPHOGLYCERATE KINASE (EC 2.7.2.3) |
| 71 | 72 | RXA00235 | GR00036 | 2365 | 1091 | ENOLASE (EC 4.2.1.11) |
| 73 | 74 | RXA01093 | GR00306 | 1552 | 122 | PYRUVATE KINASE (EC 2.7.1.40) |
| 75 | 76 | RXN02675 | VV0098 | 72801 | 70945 | PYRUVATE KINASE (EC 2.7.1.40) |
| 77 | 78 | F RXA02675 | GR00754 | 2 | 364 | PYRUVATE KINASE (EC 2.7.1.40) |
| 79 | 80 | F RXA02695 | GR00755 | 2949 | 4370 | PYRUVATE KINASE (EC 2.7.1.40) |
| 81 | 82 | RXA00682 | GR00179 | 5299 | 3401 | PHOSPHOENOLPYRUVATE SYNTHASE (EC 2.7.9.2) |
| 83 | 84 | RXA00683 | GR00179 | 6440 | 5349 | PHOSPHOENOLPYRUVATE SYNTHASE (EC 2.7.9.2) |
| 85 | 86 | RXN00635 | VV0135 | 22708 | 20972 | PYRUVATE DEHYDROGENASE (CYTOCHROME) (EC 1.2.2.2) |

-continued

| Nucleic Acid SEQ ID NO | Amino Acid SEQ ID NO | Identification Code | Contig. | NT Start | NT Stop | Function |
|---|---|---|---|---|---|---|
| 87 | 88 | F RXA02807 | GR00788 | 88 | 552 | PYRUVATE DEHYDROGENASE (CYTOCHROME) (EC 1.2.2.2) |
| 89 | 90 | F RXA00635 | GR00167 | 3 | 923 | PYRUVATE DEHYDROGENASE (CYTOCHROME) (EC 1.2.2.2) |
| 91 | 92 | RXN03044 | VV0019 | 1391 | 2221 | PYRUVATE DEHYDROGENASE E1 COMPONENT (EC 1.2.4.1) |
| 93 | 94 | F RXA02852 | GR00852 | 3 | 281 | PYRUVATE DEHYDROGENASE E1 COMPONENT (EC 1.2.4.1) |
| 95 | 96 | F RXA00268 | GR00041 | 125 | 955 | PYRUVATE DEHYDROGENASE E1 COMPONENT (EC 1.2.4.1) |
| 97 | 98 | RXN03086 | VV0049 | 2243 | 2650 | PYRUVATE DEHYDROGENASE E1 COMPONENT (EC 1.2.4.1) |
| 99 | 100 | F RXA02887 | GR10022 | 411 | 4 | PYRUVATE DEHYDROGENASE E1 COMPONENT (EC 1.2.4.1) |
| 101 | 102 | RXN03043 | VV0019 | 1 | 1362 | PYRUVATE DEHYDROGENASE E1 COMPONENT (EC 1.2.4.1) |
| 103 | 104 | F RXA02897 | GR10039 | 1291 | 5 | PYRUVATE DEHYDROGENASE E1 COMPONENT (EC 1.2.4.1) |
| 105 | 106 | RXN03083 | VV0047 | 88 | 1110 | DIHYDROLIPOAMIDE DEHYDROGENASE (EC 1.8.1.4) |
| 107 | 108 | F RXA02853 | GR10001 | 89 | 1495 | DIHYDROLIPOAMIDE DEHYDROGENASE (EC 1.8.1.4) |
| 109 | 110 | RXA02259 | GR00654 | 27401 | 30172 | PHOSPHOENOLPYRUVATE CARBOXYLASE (EC 4.1.1.31) |
| 111 | 112 | RXN02326 | VV0047 | 4500 | 5315 | PYRUVATE CARBOXYLASE (EC 6.4.1.1) |
| 113 | 114 | F RXA02326 | GR00668 | 5338 | 4523 | PYRUVATE CARBOXYLASE |
| 115 | 116 | RXN02327 | VV0047 | 3533 | 4492 | PYRUVATE CARBOXYLASE (EC 6.4.1.1) |
| 117 | 118 | F RXA02327 | GR00668 | 6305 | 5346 | PYRUVATE CARBOXYLASE |
| 119 | 120 | RXN02328 | VV0047 | 1842 | 3437 | PYRUVATE CARBOXYLASE (EC 6.4.1.1) |
| 121 | 122 | F RXA02328 | GR00668 | 7783 | 6401 | PYRUVATE CARBOXYLASE (EC 6.4.1.1) |
| 123 | 124 | RXN01048 | VV0079 | 12539 | 11316 | MALIC ENZYME (EC 1.1.1.39) |
| 125 | 126 | F RXA01048 | GR00296 | 3 | 290 | MALIC ENZYME (EC 1.1.1.39) |
| 127 | 128 | F RXA00290 | GR00046 | 4693 | 5655 | MALIC ENZYME (EC 1.1.1.39) |
| 129 | 130 | RXA02694 | GR00755 | 1879 | 2820 | L-LACTATE DEHYDROGENASE (EC 1.1.1.27) |
| 131 | 132 | RXN00296 | VV0176 | 35763 | 38606 | D-LACTATE DEHYDROGENASE (CYTOCHROME) (EC 1.1.2.4) |
| 133 | 134 | F RXA00296 | GR00048 | 3 | 2837 | D-LACTATE DEHYDROGENASE (CYTOCHROME) (EC 1.1.2.4) |
| 135 | 136 | RXA01901 | GR00544 | 4158 | 5417 | L-LACTATE DEHYDROGENASE (CYTOCHROME) (EC 1.1.2.3) |
| 137 | 138 | RXN01952 | VV0105 | 9954 | 11666 | D-LACTATE DEHYDROGENASE (EC 1.1.1.28) |
| 139 | 140 | F RXA01952 | GR00562 | 1 | 216 | D-LACTATE DEHYDROGENASE (EC 1.1.1.28) |
| 141 | 142 | F RXA01955 | GR00562 | 4611 | 6209 | D-LACTATE DEHYDROGENASE (EC 1.1.1.28) |
| 143 | 144 | RXA00293 | GR00047 | 2645 | 1734 | D-3-PHOSPHOGLYCERATE DEHYDROGENASE (EC 1.1.1.95) |
| 145 | 146 | RXN01130 | VV0157 | 6138 | 5536 | D-3-PHOSPHOGLYCERATE DEHYDROGENASE (EC 1.1.1.95) |
| 147 | 148 | F RXA01130 | GR00315 | 2 | 304 | D-3-PHOSPHOGLYCERATE DEHYDROGENASE (EC 1.1.1.95) |
| 149 | 150 | RXN03112 | VV0085 | 509 | 6 | D-3-PHOSPHOGLYCERATE DEHYDROGENASE (EC 1.1.1.95) |
| 151 | 152 | F RXA01133 | GR00316 | 568 | 1116 | D-3-PHOSPHOGLYCERATE DEHYDROGENASE (EC 1.1.1.95) |
| 153 | 154 | RXN00871 | VV0127 | 3127 | 2240 | IOLB PROTEIN |
| 155 | 156 | F RXA00871 | GR00239 | 2344 | 3207 | IOLB PROTEIN: D-FRUCTOSE 1,6-BISPHOSPHATE = GLYCERONE-CC PHOSPHATE + D-GLYCERALDEHYDE 3-PHOSPHATE. |
| 157 | 158 | RXN02829 | VV0354 | 287 | 559 | IOLS PROTEIN |
| 159 | 160 | F RXA02829 | GR00816 | 287 | 562 | IOLS PROTEIN |
| 161 | 162 | RXN01468 | VV0019 | 7474 | 8298 | NAGD PROTEIN |
| 163 | 164 | F RXA01468 | GR00422 | 1250 | 2074 | PUTATIVE N-GLYCERALDEHYDE-2-PHOSPHOTRANSFERASE |
| 165 | 166 | RXA00794 | GR00211 | 3993 | 2989 | GLPX PROTEIN |
| 167 | 168 | RXN02920 | VV0213 | 6135 | 5224 | D-3-PHOSPHOGLYCERATE DEHYDROGENASE (EC 1.1.1.95) |
| 169 | 170 | F RXA02379 | GR00690 | 1390 | 686 | D-3-PHOSPHOGLYCERATE DEHYDROGENASE (EC 1.1.1.95) |
| 171 | 172 | RXN02688 | VV0098 | 59053 | 58385 | PHOSPHOGLYCERATE MUTASE (EC 5.4.2.1) |
| 173 | 174 | RXN03087 | VV0052 | 3216 | 3428 | PYRUVATE CARBOXYLASE (EC 6.4.1.1) |
| 175 | 176 | RXN03186 | VV0377 | 310 | 519 | PYRUVATE DEHYDROGENASE E1 COMPONENT (EC 1.2.4.1) |
| 177 | 178 | RXN03187 | VV0382 | 3 | 281 | PYRUVATE DEHYDROGENASE E1 COMPONENT (EC 1.2.4.1) |
| 179 | 180 | RXN02591 | VV0098 | 14370 | 12541 | PHOSPHOENOLPYRUVATE CARBOXYKINASE [GTP] (EC 4.1.1.32) |
| 181 | 182 | RXS01260 | VV0009 | 3477 | 2296 | LIPOAMIDE DEHYDROGENASE COMPONENT (E3) OF BRANCHED-CHAIN ALPHA-KETO ACID DEHYDROGENASE COMPLEX (EC 1.8.1.4) |
| 183 | 184 | RXS01261 | VV0009 | 3703 | 3533 | LIPOAMIDE DEHYDROGENASE COMPONENT (E3) OF BRANCHED-CHAIN ALPHA-KETO ACID DEHYDROGENASE COMPLEX (EC 1.8.1.4) |
| Glycerol metabolism | | | | | | |
| 185 | 186 | RXA02640 | GR00749 | 1400 | 2926 | GLYCEROL KINASE (EC 2.7.1.30) |
| 187 | 188 | RXN01025 | VV0143 | 5483 | 4488 | GLYCEROL-3-PHOSPHATE DEHYDROGENASE (NAD(P)+) (EC 1.1.1.94) |
| 189 | 190 | F RXA01025 | GR00293 | 939 | 1853 | GLYCEROL-3-PHOSPHATE DEHYDROGENASE (NAD(P)+) (EC 1.1.1.94) |
| 191 | 192 | RXA01851 | GR00525 | 3515 | 1830 | AEROBIC GLYCEROL-3-PHOSPHATE DEHYDROGENASE (EC 1.1.99.5) |
| 193 | 194 | RXA01242 | GR00359 | 1526 | 2302 | GLYCEROL-3-PHOSPHATE REGULON REPRESSOR |
| 195 | 196 | RXA02288 | GR00661 | 992 | 147 | GLYCEROL-3-PHOSPHATE REGULON REPRESSOR |
| 197 | 198 | RXN01891 | VV0122 | 24949 | 24086 | GLYCEROL-3-PHOSPHATE-BINDING PERIPLASMIC PROTEIN PRECURSOR |
| 199 | 200 | F RXA01891 | GR00541 | 1736 | 918 | GLYCEROL-3-PHOSPHATE-BINDING PERIPLASMIC PROTEIN PRECURSOR |
| 201 | 202 | RXA02414 | GR00703 | 3808 | 3062 | Uncharacterized protein involved in glycerol metabolism (homolog of *Drosophila rhomboid*) |
| 203 | 204 | RXN01580 | VV0122 | 22091 | 22807 | Glycerophosphoryl diester phosphodiesterase |

-continued

| Nucleic Acid SEQ ID NO | Amino Acid SEQ ID NO | Identification Code | Contig. | NT Start | NT Stop | Function |
|---|---|---|---|---|---|---|
| Acetate metabolism | | | | | | |
| 205 | 206 | RXA01436 | GR00418 | 2547 | 1357 | ACETATE KINASE (EC 2.7.2.1) |
| 207 | 208 | RXA00686 | GR00179 | 8744 | 7941 | ACETATE OPERON REPRESSOR |
| 209 | 210 | RXA00246 | GR00037 | 4425 | 3391 | ALCOHOL DEHYDROGENASE (EC 1.1.1.1) |
| 211 | 212 | RXA01571 | GR00438 | 1360 | 1959 | ALCOHOL DEHYDROGENASE (EC 1.1.1.1) |
| 213 | 214 | RXA01572 | GR00438 | 1928 | 2419 | ALCOHOL DEHYDROGENASE (EC 1.1.1.1) |
| 215 | 216 | RXA01758 | GR00498 | 3961 | 2945 | ALCOHOL DEHYDROGENASE (EC 1.1.1.1) |
| 217 | 218 | RXA02539 | GR00726 | 11676 | 10159 | ALDEHYDE DEHYDROGENASE (EC |
| 219 | 220 | RXN03061 | VV0034 | 108 | 437 | ALDEHYDE DEHYDROGENASE (EC 1.2.1.3) |
| 221 | 222 | RXN03150 | VV0155 | 10678 | 10055 | ALDEHYDE DEHYDROGENASE (EC 1.2.1.3) |
| 223 | 224 | RXN01340 | VV0033 | 3 | 860 | ALDEHYDE DEHYDROGENASE (EC 1.2.1.3) |
| 225 | 226 | RXN01498 | VV0008 | 1598 | 3160 | ALDEHYDE DEHYDROGENASE (EC 1.2.1.3) |
| 227 | 228 | RXN02674 | VV0315 | 15614 | 14163 | ALDEHYDE DEHYDROGENASE (EC 1.2.1.3) |
| 229 | 230 | RXN00868 | VV0127 | 2230 | 320 | ACETOLACTATE SYNTHASE LARGE SUBUNIT (EC 4.1.3.18) |
| 231 | 232 | RXN01143 | VV0077 | 9372 | 8254 | ACETOLACTATE SYNTHASE LARGE SUBUNIT (EC 4.1.3.18) |
| 233 | 234 | RXN01146 | VV0264 | 243 | 935 | ACETOLACTATE SYNTHASE LARGE SUBUNIT (EC 4.1.3.18) |
| 235 | 236 | RXN01144 | VV0077 | 8237 | 7722 | ACETOLACTATE SYNTHASE SMALL SUBUNIT (EC 4.1.3.18) |
| Butanediol, diacetyl and acetoin formation | | | | | | |
| 237 | 238 | RXA02474 | GR00715 | 8082 | 7309 | (S,S)-butane-2,3-diol dehydrogenase (EC 1.1.1.76) |
| 239 | 240 | RXA02453 | GR00710 | 6103 | 5351 | ACETOIN(DIACETYL) REDUCTASE (EC 1.1.1.5) |
| 241 | 242 | RXS01758 | VV0112 | 27383 | 28399 | ALCOHOL DEHYDROGENASE (EC 1.1.1.1) |
| HMP-Cycle | | | | | | |
| 243 | 244 | RXA02737 | GR00763 | 3312 | 1771 | GLUCOSE-6-PHOSPHATE 1-DEHYDROGENASE (EC 1.1.1.49) |
| 245 | 246 | RXA02738 | GR00763 | 4499 | 3420 | TRANSALDOLASE (EC 2.2.1.2) |
| 247 | 248 | RXA02739 | GR00763 | 6469 | 4670 | TRANSKETOLASE (EC 2.2.1.1) |
| 249 | 250 | RXA00965 | GR00270 | 1232 | 510 | 6-PHOSPHOGLUCONATE DEHYDROGENASE, DECARBOXYLATING (EC 1.1.1.44) |
| 251 | 252 | RXN00999 | VV0106 | 2817 | 1366 | 6-PHOSPHOGLUCONATE DEHYDROGENASE, DECARBOXYLATING (EC 1.1.1.44) |
| 253 | 254 | F RXA00999 | GR00283 | 3012 | 4448 | 6-PHOSPHOGLUCONATE DEHYDROGENASE, DECARBOXYLATING (EC 1.1.1.44) |
| Nucleotide sugar conversion | | | | | | |
| 255 | 256 | RXN02596 | VV0098 | 48784 | 47582 | UDP-GALACTOPYRANOSE MUTASE (EC 5.4.99.9) |
| 257 | 258 | F RXA02596 | GR00742 | 1 | 489 | UDP-GALACTOPYRANOSE MUTASE (EC 5.4.99.9) |
| 259 | 260 | F RXA02642 | GR00749 | 5383 | 5880 | UDP-GALACTOPYRANOSE MUTASE (EC 5.4.99.9) |
| 261 | 262 | RXA02572 | GR00737 | 2 | 646 | UDP-GLUCOSE 6-DEHYDROGENASE (EC 1.1.1.22) |
| 263 | 264 | RXA02485 | GR00718 | 2345 | 3445 | UDP-N-ACETYLENOLPYRUVOYLGLUCOSAMINE REDUCTASE (EC 1.1.1.158) |
| 265 | 266 | RXA01216 | GR00352 | 2302 | 1202 | UDP-N-ACETYLGLUCOSAMINE PYROPHOSPHORYLASE (EC 2.7.7.23) |
| 267 | 268 | RXA01259 | GR00367 | 987 | 130 | UTP-GLUCOSE-1-PHOSPHATE URIDYLYLTRANSFERASE (EC 2.7.7.9) |
| 269 | 270 | RXA02028 | GR00616 | 573 | 998 | UTP-GLUCOSE-1-PHOSPHATE URIDYLYLTRANSFERASE (EC 2.7.7.9) |
| 271 | 272 | RXA01262 | GR00367 | 8351 | 7191 | GDP-MANNOSE 6-DEHYDROGENASE (EC 1.1.1.132) |
| 273 | 274 | RXA01377 | GR00400 | 3935 | 5020 | MANNOSE-1-PHOSPHATE GUANYLTRANSFERASE (EC 2.7.7.13) |
| 275 | 276 | RXA02063 | GR00626 | 3301 | 4527 | GLUCOSE-1-PHOSPHATE ADENYLYLTRANSFERASE (EC 2.7.7.27) |
| 277 | 278 | RXN00014 | VV0048 | 8848 | 9627 | GLUCOSE-1-PHOSPHATE THYMIDYLYLTRANSFERASE (EC 2.7.7.24) |
| 279 | 280 | F RXA00014 | GR00002 | 4448 | 5227 | GLUCOSE-1-PHOSPHATE THYMIDYLYLTRANSFERASE (EC 2.7.7.24) |
| 281 | 282 | RXA01570 | GR00438 | 427 | 1281 | GLUCOSE-1-PHOSPHATE THYMIDYLYLTRANSFERASE (EC 2.7.7.24) |
| 283 | 284 | RXA02666 | GR00753 | 7260 | 6493 | D-RIBITOL-5-PHOSPHATE CYTIDYLYLTRANSFERASE (EC 2.7.7.40) |
| 285 | 286 | RXA00825 | GR00222 | 222 | 1154 | DTDP-GLUCOSE 4,6-DEHYDRATASE (EC 4.2.1.46) |
| Inositol and ribitol metabolism | | | | | | |
| 287 | 288 | RXA01887 | GR00539 | 4219 | 3209 | MYO-INOSITOL 2-DEHYDROGENASE (EC 1.1.1.18) |
| 289 | 290 | RXN00013 | VV0048 | 7966 | 8838 | MYO-INOSITOL-1(OR 4)-MONOPHOSPHATASE 1 (EC 3.1.3.25) |
| 291 | 292 | F RXA00013 | GR00002 | 3566 | 4438 | MYO-INOSITOL-1(OR 4)-MONOPHOSPHATASE 1 (EC 3.1.3.25) |
| 293 | 294 | RXA01099 | GR00306 | 6328 | 5504 | INOSITOL MONOPHOSPHATE PHOSPHATASE |
| 295 | 296 | RXN01332 | VV0273 | 579 | 4 | MYO-INOSITOL 2-DEHYDROGENASE (EC 1.1.1.18) |
| 297 | 298 | F RXA01332 | GR00388 | 552 | 4 | MYO-INOSITOL 2-DEHYDROGENASE (EC 1.1.1.18) |
| 299 | 300 | RXA01632 | GR00454 | 2338 | 3342 | MYO-INOSITOL 2-DEHYDROGENASE (EC 1.1.1.18) |
| 301 | 302 | RXA01633 | GR00454 | 3380 | 4462 | MYO-INOSITOL 2-DEHYDROGENASE (EC 1.1.1.18) |
| 303 | 304 | RXN01406 | VV0278 | 2999 | 1977 | MYO-INOSITOL 2-DEHYDROGENASE (EC 1.1.1.18) |
| 305 | 306 | RXN01630 | VV0050 | 48113 | 47037 | MYO-INOSITOL 2-DEHYDROGENASE (EC 1.1.1.18) |
| 307 | 308 | RXN00528 | VV0079 | 23406 | 22318 | MYO-INOSITOL-1-PHOSPHATE SYNTHASE (EC 5.5.1.4) |
| 309 | 310 | RXN03057 | VV0028 | 7017 | 7688 | MYO-INOSITOL 2-DEHYDROGENASE (EC 1.1.1.18) |

-continued

| Nucleic Acid SEQ ID NO | Amino Acid SEQ ID NO | Identification Code | Contig. | NT Start | NT Stop | Function |
|---|---|---|---|---|---|---|
| 311 | 312 | F RXA02902 | GR10040 | 10277 | 10948 | GLUCOSE-FRUCTOSE OXIDOREDUCTASE PRECURSOR (EC 1.1.99.28) |
| 313 | 314 | RXA00251 | GR00038 | 931 | 224 | RIBITOL 2-DEHYDROGENASE (EC 1.1.1.56) |
| Utilization of sugars | | | | | | |
| 315 | 316 | RXN02654 | VV0090 | 12206 | 13090 | GLUCOSE 1-DEHYDROGENASE (EC 1.1.1.47) |
| 317 | 318 | F RXA02654 | GR00752 | 7405 | 8289 | GLUCOSE 1-DEHYDROGENASE II (EC 1.1.1.47) |
| 319 | 320 | RXN01049 | VV0079 | 9633 | 11114 | GLUCONOKINASE (EC 2.7.1.12) |
| 321 | 322 | F RXA01049 | GR00296 | 1502 | 492 | GLUCONOKINASE (EC 2.7.1.12) |
| 323 | 324 | F RXA01050 | GR00296 | 1972 | 1499 | GLUCONOKINASE (EC 2.7.1.12) |
| 325 | 326 | RXA00202 | GR00032 | 1216 | 275 | D-RIBOSE-BINDING PERIPLASMIC PROTEIN PRECURSOR |
| 327 | 328 | RXN00872 | VV0127 | 6557 | 5604 | FRUCTOKINASE (EC 2.7.1.4) |
| 329 | 330 | F RXA00872 | GR00240 | 565 | 1086 | FRUCTOKINASE (EC 2.7.1.4) |
| 331 | 332 | RXN00799 | VV0009 | 58477 | 56834 | PERIPLASMIC BETA-GLUCOSIDASE/BETA-XYLOSIDASE PRECURSOR (EC 3.2.1.21) (EC 3.2.1.37) |
| 333 | 334 | F RXA00799 | GR00214 | 1 | 1584 | PERIPLASMIC BETA-GLUCOSIDASE/BETA-XYLOSIDASE PRECURSOR (EC 3.2.1.21) (EC 3.2.1.37) |
| 335 | 336 | RXA00032 | GR00003 | 12028 | 10520 | MANNITOL 2-DEHYDROGENASE (EC 1.1.1.67) |
| 337 | 338 | RXA02528 | GR00725 | 6880 | 7854 | FRUCTOSE REPRESSOR |
| 339 | 340 | RXN00316 | VV0006 | 7035 | 8180 | Hypothetical Oxidoreductase |
| 341 | 342 | F RXA00309 | GR00053 | 316 | 5 | GLUCOSE--FRUCTOSE OXIDOREDUCTASE PRECURSOR (EC 1.1.99.28) |
| 343 | 344 | RXN00310 | VV0006 | 6616 | 7050 | GLUCOSE--FRUCTOSE OXIDOREDUCTASE PRECURSOR (EC 1.1.99.28) |
| 345 | 346 | F RXA00310 | GR00053 | 735 | 301 | GLUCOSE--FRUCTOSE OXIDOREDUCTASE PRECURSOR (EC 1.1.99.28) |
| 347 | 348 | RXA00041 | GR00007 | 1246 | 5 | SUCROSE-6-PHOSPHATE HYDROLASE (EC 3.2.1.26) |
| 349 | 350 | RXA02026 | GR00615 | 725 | 6 | SUCROSE-6-PHOSPHATE HYDROLASE (EC 3.2.1.26) |
| 351 | 352 | RXA02061 | GR00626 | 1842 | 349 | SUCROSE-6-PHOSPHATE HYDROLASE (EC 3.2.1.26) |
| 353 | 354 | RXN01369 | VV0124 | 595 | 1776 | MANNOSE-6-PHOSPHATE ISOMERASE (EC 5.3.1.8) |
| 355 | 356 | F RXA01369 | GR00398 | 3 | 503 | MANNOSE-6-PHOSPHATE ISOMERASE (EC 5.3.1.8) |
| 357 | 358 | F RXA01373 | GR00399 | 595 | 1302 | MANNOSE-6-PHOSPHATE ISOMERASE (EC 5.3.1.8) |
| 359 | 360 | RXA02611 | GR00743 | 1 | 1752 | 1,4-ALPHA-GLUCAN BRANCHING ENZYME (EC 2.4.1.18) |
| 361 | 362 | RXA02612 | GR00743 | 1793 | 3985 | 1,4-ALPHA-GLUCAN BRANCHING ENZYME (EC 2.4.1.18) |
| 363 | 364 | RXN01884 | VV0184 | 1 | 1890 | GLYCOGEN DEBRANCHING ENZYME (EC 2.4.1.25) (EC 3.2.1.33) |
| 365 | 366 | F RXA01884 | GR00539 | 3 | 1475 | GLYCOGEN DEBRANCHING ENZYME (EC 2.4.1.25) (EC 3.2.1.33) |
| 367 | 368 | RXA01111 | GR00306 | 16981 | 17427 | GLYCOGEN OPERON PROTEIN GLGX (EC 3.2.1.—) |
| 369 | 370 | RXN01550 | VV0143 | 14749 | 16260 | GLYCOGEN PHOSPHORYLASE (EC 2.4.1.1) |
| 371 | 372 | F RXA01550 | GR00431 | 3 | 1346 | GLYCOGEN PHOSPHORYLASE (EC 2.4.1.1) |
| 373 | 374 | RXN02100 | VV0318 | 2 | 2326 | GLYCOGEN PHOSPHORYLASE (EC 2.4.1.1) |
| 375 | 376 | F RXA02100 | GR00631 | 3 | 920 | GLYCOGEN PHOSPHORYLASE (EC 2.4.1.1) |
| 377 | 378 | F RXA02113 | GR00633 | 2 | 1207 | GLYCOGEN PHOSPHORYLASE (EC 2.4.1.1) |
| 379 | 380 | RXA02147 | GR00639 | 15516 | 16532 | ALPHA-AMYLASE (EC 3.2.1.1) |
| 381 | 382 | RXA01478 | GR00422 | 10517 | 12352 | GLUCOAMYLASE G1 AND G2 PRECURSOR (EC 3.2.1.3) |
| 383 | 384 | RXA01888 | GR00539 | 4366 | 4923 | GLUCOSE-RESISTANCE AMYLASE REGULATOR |
| 385 | 386 | RXN01927 | VV0127 | 50623 | 49244 | XYLULOSE KINASE (EC 2.7.1.17) |
| 387 | 388 | F RXA01927 | GR00555 | 3 | 1118 | XYLULOSE KINASE (EC 2.7.1.17) |
| 389 | 390 | RXA02729 | GR00762 | 747 | 4 | RIBOKINASE (EC 2.7.1.15) |
| 391 | 392 | RXA02797 | GR00778 | 1739 | 2641 | RIBOKINASE (EC 2.7.1.15) |
| 393 | 394 | RXA02730 | GR00762 | 1768 | 731 | RIBOSE OPERON REPRESSOR |
| 395 | 396 | RXA02551 | GR00729 | 2193 | 2552 | 6-PHOSPHO-BETA-GLUCOSIDASE (EC 3.2.1.86) |
| 397 | 398 | RXA01325 | GR00385 | 5676 | 5005 | DEOXYRIBOSE-PHOSPHATE ALDOLASE (EC 4.1.2.4) |
| 399 | 400 | RXA00195 | GR00030 | 543 | 1103 | 1-deoxy-D-xylulose 5-phosphate reductoisomerase (EC 1.1.1.—) |
| 401 | 402 | RXA00196 | GR00030 | 1094 | 1708 | 1-deoxy-D-xylulose 5-phosphate reductoisomerase (EC 1.1.1.—) |
| 403 | 404 | RNX01562 | VV0191 | 1230 | 3137 | 1-DEOXYXYLULOSE-5-PHOSPHATE SYNTHASE |
| 405 | 406 | F RXA01562 | GR00436 | 2 | 1039 | 1-DEOXYXYLULOSE-5-PHOSPHATE SYNTHASE |
| 407 | 408 | F RXA01705 | GR00480 | 971 | 1573 | 1-DEOXYXYLULOSE-5-PHOSPHATE SYNTHASE |
| 409 | 410 | RXN00879 | VV0099 | 8763 | 6646 | 4-ALPHA-GLUCANOTRANSFERASE (EC 2.4.1.25) |
| 411 | 412 | F RXA00879 | GR00242 | 5927 | 3828 | 4-ALPHA-GLUCANOTRANSFERASE (EC 2.4.1.25), amylomaltase |
| 413 | 414 | RXN00043 | VV0119 | 3244 | 2081 | N-ACETYLGLUCOSAMINE-6-PHOSPHATE DEACETYLASE (EC 3.5.1.25) |
| 415 | 416 | F RXA00043 | GR00007 | 3244 | 2081 | N-ACETYLGLUCOSAMINE-6-PHOSPHATE DEACETYLASE (EC 3.5.1.25) |
| 417 | 418 | RXN01752 | VV0127 | 35265 | 33805 | N-ACETYLGLUCOSAMINYLTRANSFERASE (EC 2.4.1.—) |
| 419 | 420 | F RXA01839 | GR00520 | 1157 | 510 | N-ACETYLGLUCOSAMINYLTRANSFERASE (EC 2.4.1.—) |
| 421 | 422 | RXA01859 | GR00529 | 1473 | 547 | N-ACETYLGLUCOSAMINYLTRANSFERASE (EC 2.4.1.—) |
| 423 | 424 | RXA00042 | GR00007 | 2037 | 1279 | GLUCOSAMINE-6-PHOSPHATE ISOMERASE (EC 5.3.1.10) |
| 425 | 426 | RXA01482 | GR00422 | 17271 | 15397 | GLUCOSAMINE--FRUCTOSE-6-PHOSPHATE AMINOTRANSFERASE (ISOMERIZING) (EC 2.6.1.16) |
| 427 | 428 | RXN03179 | VV0336 | 2 | 667 | URONATE ISOMERASE (EC 5.3.1.12) |
| 429 | 430 | F RXA02872 | GR10013 | 675 | 4 | URONATE ISOMERASE, Glucuronate isomerase (EC 5.3.1.12) |
| 431 | 432 | RXN03180 | VV0337 | 672 | 163 | URONATE ISOMERASE (EC 5.3.1.12) |
| 433 | 434 | F RXA02873 | GR10014 | 672 | 163 | URONATE ISOMERASE (EC 5.3.1.12) |
| 435 | 436 | RXA02292 | GR00662 | 1611 | 2285 | GALACTOSIDE O-ACETYLTRANSFERASE (EC 2.3.1.18) |

-continued

| Nucleic Acid SEQ ID NO | Amino Acid SEQ ID NO | Identification Code | Contig. | NT Start | NT Stop | Function |
|---|---|---|---|---|---|---|
| 437 | 438 | RXA02666 | GR00753 | 7260 | 6493 | D-RIBITOL-5-PHOSPHATE CYTIDYLYLTRANSFERASE (EC 2.7.7.40) |
| 439 | 440 | RXA00202 | GR00032 | 1216 | 275 | D-RIBOSE-BINDING PERIPLASMIC PROTEIN PRECURSOR |
| 441 | 442 | RXA02440 | GR00709 | 5097 | 4258 | D-RIBOSE-BINDING PERIPLASMIC PROTEIN PRECURSOR |
| 443 | 444 | RXN01569 | VV0009 | 41086 | 42444 | dTDP-4-DEHYDRORHAMNOSE REDUCTASE (EC 1.1.1.133) |
| 445 | 446 | F RXA01569 | GR00438 | 2 | 427 | DTDP-4-DEHYDRORHAMNOSE REDUCTASE (EC 1.1.1.133) |
| 447 | 448 | F RXA02055 | GR00624 | 7122 | 8042 | DTDP-4-DEHYDRORHAMNOSE REDUCTASE (EC 1.1.1.133) |
| 449 | 450 | RXA00825 | GR00222 | 222 | 1154 | DTDP-GLUCOSE 4,6-DEHYDRATASE (EC 4.2.1.46) |
| 451 | 452 | RXA02054 | GR00624 | 6103 | 7119 | DTDP-GLUCOSE 4,6-DEHYDRATASE (EC 4.2.1.46) |
| 453 | 454 | RXN00427 | VV0112 | 7004 | 6219 | dTDP-RHAMNOSYL TRANSFERASE RFBF (EC 2.—.—.—) |
| 455 | 456 | F RXA00427 | GR00098 | 1591 | 2022 | DTDP-RHAMNOSYL TRANSFERASE RFBF (EC 2.—.—.—) |
| 457 | 458 | RXA00327 | GR00057 | 10263 | 9880 | PROTEIN ARAJ |
| 459 | 460 | RXA00328 | GR00057 | 11147 | 10656 | PROTEIN ARAJ |
| 461 | 462 | RXA00329 | GR00057 | 12390 | 11167 | PROTEIN ARAJ |
| 463 | 464 | RXN01554 | VV0135 | 28686 | 26545 | GLUCAN ENDO-1,3-BETA-GLUCOSIDASE A1 PRECURSOR (EC 3.2.1.39) |
| 465 | 466 | RXN03015 | VV0063 | 289 | 8 | UDP-GLUCOSE 6-DEHYDROGENASE (EC 1.1.1.22) |
| 467 | 468 | RXN03056 | VV0028 | 6258 | 6935 | PUTATIVE HEXULOSE-6-PHOSPHATE ISOMERASE (EC 5.—.—.—) |
| 469 | 470 | RXN03030 | VV0009 | 57006 | 56443 | PERIPLASMIC BETA-GLUCOSIDASE/BETA-XYLOSIDASE PRECURSOR (EC 3.2.1.21) (EC 3.2.1.37) |
| 471 | 472 | RXN00401 | VV0025 | 12427 | 11489 | 5-DEHYDRO-4-DEOXYGLUCARATE DEHYDRATASE (EC 4.2.1.41) |
| 473 | 474 | RXN02125 | VV0102 | 23242 | 22442 | ALDOSE REDUCTASE (EC 1.1.1.21) |
| 475 | 476 | RXN00200 | VV0181 | 1679 | 5116 | arabinosyl transferase subunit B (EC 2.4.2.—) |
| 477 | 478 | RXN01175 | VV0017 | 39688 | 38303 | PHOSPHO-2-DEHYDRO-3-DEOXYHEPTONATE ALDOLASE (EC 4.1.2.15) |
| 479 | 480 | RXN01376 | VV0091 | 5610 | 4750 | PUTATIVE GLYCOSYL TRANSFERASE WBIF |
| 481 | 482 | RXN01631 | VV0050 | 47021 | 46143 | PUTATIVE HEXULOSE-6-PHOSPHATE ISOMERASE (EC 5.—.—.—) |
| 483 | 484 | RXN01593 | VV0229 | 13274 | 12408 | NAGD PROTEIN |
| 485 | 486 | RXN00337 | VV0197 | 20369 | 21418 | GALACTOKINASE (EC 2.7.1.6) |
| 487 | 488 | RXS00584 | VV0323 | 5516 | 6640 | PHOSPHO-2-DEHYDRO-3-DEOXYHEPTONATE ALDOLASE (EC 4.1.2.15) |
| 489 | 490 | RXS02574 | | | | BETA-HEXOSAMINIDASE A PRECURSOR (EC 3.2.1.52) |
| 491 | 492 | RXS03215 | | | | GLUCOSE--FRUCTOSE OXIDOREDUCTASE PRECURSOR (EC 1.1.99.28) |
| 493 | 494 | F RXA01915 | GR00549 | 1 | 1008 | GLUCOSE--FRUCTOSE OXIDOREDUCTASE PRECURSOR (EC 1.1.99.28) |
| 495 | 496 | RXS03224 | | | | CYCLOMALTODEXTRINASE (EC 3.2.1.54) |
| 497 | 498 | F RXA00038 | GR00006 | 1417 | 260 | CYCLOMALTODEXTRINASE (EC 3.2.1.54) |
| 499 | 500 | RXC00233 | | | | protein involved in sugar metabolism |
| 501 | 502 | RXC00236 | | | | Membrane Lipoprotein involved in sugar metabolism |
| 503 | 504 | RXC00271 | | | | Exported Protein involved in ribose metabolism |
| 505 | 506 | RXC00338 | | | | protein involved in sugar metabolism |
| 507 | 508 | RXC00362 | | | | Membrane Spanning Protein involved in metabolism of diols |
| 509 | 510 | RXC00412 | | | | Amino Acid ABC Transporter ATP-Binding Protein involved in sugar metabolism |
| 511 | 512 | RXC00526 | | | | ABC Transporter ATP-Binding Protein involved in sugar metabolism |
| 513 | 514 | RXC01004 | | | | Membrane Spanning Protein involved in sugar metabolism |
| 515 | 516 | RXC01017 | | | | Cytosolic Protein involved in sugar metabolism |
| 517 | 518 | RXC01021 | | | | Cytosolic Kinase involved in sugar metabolism |
| 519 | 520 | RXC01212 | | | | ABC Transporter ATP-Binding Protein involved in sugar metabolism |
| 521 | 522 | RXC01306 | | | | Membrane Spanning Protein involved in sugar metabolism |
| 523 | 524 | RXC01366 | | | | Cytosolic Protein involved in sugar metabolism |
| 525 | 526 | RXC01372 | | | | Cytosolic Protein involved in sugar metabolism |
| 527 | 528 | RXC01659 | | | | protein involved in sugar metabolism |
| 529 | 530 | RXC01663 | | | | protein involved in sugar metabolism |
| 531 | 532 | RXC01693 | | | | protein involved in sugar metabolism |
| 533 | 534 | RXC01703 | | | | Cytosolic Protein involved in sugar metabolism |
| 535 | 536 | RXC02254 | | | | Membrane Associated Protein involved in sugar metabolism |
| 537 | 538 | RXC02255 | | | | Cytosolic Protein involved in sugar metabolism |
| 539 | 540 | RXC02435 | | | | protein involved in sugar metabolism |
| 541 | 542 | F RXA02435 | GR00709 | 825 | 268 | Uncharacterized protein involved in glycerol metabolism (homolog of *Drosophilia rhomboid*) |
| 543 | 544 | RXC03216 | | | | protein involved in sugar metabolism |
| TCA-cycle | | | | | | |
| 545 | 546 | RXA02175 | GR00641 | 10710 | 9418 | CITRATE SYNTHASE (EC 4.1.3.7) |
| 547 | 548 | RXA02621 | GR00746 | 2647 | 1829 | CITRATE LYASE BETA CHAIN (EC 4.1.3.6) |
| 549 | 550 | RXN00519 | VV0144 | 5585 | 3372 | ISOCITRATE DEHYDROGENASE (NADP) (EC 1.1.1.42) |
| 551 | 552 | F RXA00521 | GR00133 | 2 | 1060 | ISOCITRATE DEHYDROGENASE (NADP) (EC 1.1.1.42) |
| 553 | 554 | RXN02209 | VV0304 | 1 | 1671 | ACONITATE HYDRATASE (EC 4.2.1.3) |
| 555 | 556 | F RXA02209 | GR00648 | 3 | 1661 | ACONITATE HYDRATASE (EC 4.2.1.3) |
| 557 | 558 | RXN02213 | VV0305 | 1378 | 2151 | ACONITATE HYDRATASE (EC 4.2.1.3) |
| 559 | 560 | F RXA02213 | GR00649 | 1330 | 2046 | ACONITATE HYDRATASE (EC 4.2.1.3) |

-continued

| Nucleic Acid SEQ ID NO | Amino Acid SEQ ID NO | Identification Code | Contig. | NT Start | NT Stop | Function |
|---|---|---|---|---|---|---|
| 561 | 562 | RXA02056 | GR00625 | 3 | 2870 | 2-OXOGLUTARATE DEHYDROGENASE E1 COMPONENT (EC 1.2.4.2) |
| 563 | 564 | RXA01745 | GR00495 | 2 | 1495 | DIHYDROLIPOAMIDE SUCCINYLTRANSFERASE COMPONENT (E2) OF 2-OXOGLUTARATE DEHYDROGENASE COMPLEX (EC 2.3.1.61) |
| 565 | 566 | RXA00782 | GR00206 | 3984 | 3103 | SUCCINYL-COA SYNTHETASE ALPHA CHAIN (EC 6.2.1.5) |
| 567 | 568 | RXA00783 | GR00206 | 5280 | 4009 | SUCCINYL-COA SYNTHETASE BETA CHAIN (EC 6.2.1.5) |
| 569 | 570 | RXN01695 | VV0139 | 11307 | 12806 | L-MALATE DEHYDROGENASE (ACCEPTOR) (EC 1.1.99.16) |
| 571 | 572 | F RXA01615 | GR00449 | 8608 | 9546 | L-MALATE DEHYDROGENASE (ACCEPTOR) (EC 1.1.99.16) |
| 573 | 574 | F RXA01695 | GR00474 | 4388 | 4179 | L-MALATE DEHYDROGENASE (ACCEPTOR) (EC 1.1.99.16) |
| 575 | 576 | RXA00290 | GR00046 | 4693 | 5655 | MALIC ENZYME (EC 1.1.1.39) |
| 577 | 578 | RXN01048 | VV0079 | 12539 | 11316 | MALIC ENZYME (EC 1.1.1.39) |
| 579 | 580 | F RXA01048 | GR00296 | 3 | 290 | MALIC ENZYME (EC 1.1.1.39) |
| 581 | 582 | F RXA00290 | GR00046 | 4693 | 5655 | MALIC ENZYME (EC 1.1.1.39) |
| 583 | 584 | RXN03101 | VV0066 | 2 | 583 | DIHYDROLIPOAMIDE SUCCINYLTRANSFERASE COMPONENT (E2) OF 2-OXOGLUTARATE DEHYDROGENASE COMPLEX (EC 2.3.1.61) |
| 585 | 586 | RXN02046 | VV0025 | 15056 | 14640 | DIHYDROLIPOAMIDE SUCCINYLTRANSFERASE COMPONENT (E2) OF 2-OXOGLUTARATE DEHYDROGENASE COMPLEX (EC 2.3.1.61) |
| 587 | 588 | RXN00389 | VV0025 | 11481 | 9922 | oxoglutarate semialdehyde dehydrogenase (EC 1.2.1.—) |

Glyoxylate bypass

| Nucleic Acid SEQ ID NO | Amino Acid SEQ ID NO | Identification Code | Contig. | NT Start | NT Stop | Function |
|---|---|---|---|---|---|---|
| 589 | 590 | RXN02399 | VV0176 | 19708 | 18365 | ISOCITRATE LYASE (EC 4.1.3.1) |
| 591 | 592 | F RXA02399 | GR00699 | 478 | 1773 | ISOCITRATE LYASE (EC 4.1.3.1) |
| 593 | 594 | RXN02404 | VV0176 | 20259 | 22475 | MALATE SYNTHASE (EC 4.1.3.2) |
| 595 | 596 | F RXA02404 | GR00700 | 3798 | 1663 | MALATE SYNTHASE (EC 4.1.3.2) |
| 597 | 598 | RXA01089 | GR00304 | 3209 | 3958 | GLYOXYLATE-INDUCED PROTEIN |
| 599 | 600 | RXA01886 | GR00539 | 3203 | 2430 | GLYOXYLATE-INDUCED PROTEIN |

Methylcitrrate-pathway

| Nucleic Acid SEQ ID NO | Amino Acid SEQ ID NO | Identification Code | Contig. | NT Start | NT Stop | Function |
|---|---|---|---|---|---|---|
| 601 | 602 | RXN03117 | VV0092 | 3087 | 1576 | 2-methylisocitrate synthase (EC 5.3.3.—) |
| 603 | 604 | F RXA00406 | GR00090 | 978 | 4 | 2-methylisocitrate synthase (EC 5.3.3.—) |
| 605 | 606 | F RXA00514 | GR00130 | 1983 | 1576 | 2-methylisocitrate synthase (EC 5.3.3.—) |
| 607 | 608 | RXA00512 | GR00130 | 621 | 4 | 2-methylcitrate synthase (EC 4.1.3.31) |
| 609 | 610 | RXA00518 | GR00131 | 3069 | 2773 | 2-methylcitrate synthase (EC 4.1.3.31) |
| 611 | 612 | RXA01077 | GR00300 | 4647 | 6017 | 2-methylisocitrate synthase (EC 5.3.3.—) |
| 613 | 614 | RXN03144 | VV0141 | 2 | 901 | 2-methylisocitrate synthase (EC 5.3.3.—) |
| 615 | 616 | F RXA02322 | GR00668 | 415 | 5 | 2-methylisocitrate synthase (EC 5.3.3.—) |
| 617 | 618 | RXA02329 | GR00669 | 607 | 5 | 2-methylisocitrate synthase (EC 5.3.3.—) |
| 619 | 620 | RXA02332 | GR00671 | 1906 | 764 | 2-methylcitrate synthase (EC 4.1.3.31) |
| 621 | 622 | RXN02333 | VV0141 | 901 | 1815 | methylisocitrate lyase (EC 4.1.3.30) |
| 623 | 624 | F RXA02333 | GR00671 | 2120 | 1902 | methylisocitrate lyase (EC 4.1.3.30) |
| 625 | 626 | RXA00030 | GR00003 | 9590 | 9979 | LACTOYLGLUTATHIONE LYASE (EC 4.4.1.5) |

Methyl-Malonyl-CoA-Mutases

| Nucleic Acid SEQ ID NO | Amino Acid SEQ ID NO | Identification Code | Contig. | NT Start | NT Stop | Function |
|---|---|---|---|---|---|---|
| 627 | 628 | RXN00148 | VV0167 | 9849 | 12059 | METHYLMALONYL-COA MUTASE ALPHA-SUBUNIT (EC 5.4.99.2) |
| 629 | 630 | F RXA00148 | GR00023 | 2002 | 5 | METHYLMALONYL-COA MUTASE ALPHA-SUBUNIT (EC 5.4.99.2) |
| 631 | 632 | RXA00149 | GR00023 | 3856 | 2009 | METHYLMALONYL-COA MUTASE BETA-SUBUNIT (EC 5.4.99.2) |

Others

| Nucleic Acid SEQ ID NO | Amino Acid SEQ ID NO | Identification Code | Contig. | NT Start | NT Stop | Function |
|---|---|---|---|---|---|---|
| 633 | 634 | RXN00317 | VV0197 | 26879 | 27532 | PHOSPHOGLYCOLATE PHOSPHATASE (EC 3.1.3.18) |
| 635 | 636 | F RXA00317 | GR00055 | 344 | 6 | PHOSPHOGLYCOLATE PHOSPHATASE (EC 3.1.3.18) |
| 637 | 638 | RXA02196 | GR00645 | 3956 | 3264 | PHOSPHOGLYCOLATE PHOSPHATASE (EC 3.1.3.18) |
| 639 | 640 | RXN02461 | VV0124 | 14236 | 14643 | PHOSPHOGLYCOLATE PHOSPHATASE (EC 3.1.3.18) |

Redox Chain

| Nucleic Acid SEQ ID NO | Amino Acid SEQ ID NO | Identification Code | Contig. | NT Start | NT Stop | Function |
|---|---|---|---|---|---|---|
| 641 | 642 | RXN01744 | VV0174 | 2350 | 812 | CYTOCHROME D UBIQUINOL OXIDASE SUBUNIT I (EC 1.10.3.—) |
| 643 | 644 | F RXA00055 | GR00008 | 11753 | 11890 | CYTOCHROME D UBIQUINOL OXIDASE SUBUNIT I (EC 1.10.3.—) |
| 645 | 646 | F RXA01744 | GR00494 | 2113 | 812 | CYTOCHROME D UBIQUINOL OXIDASE SUBUNIT I (EC 1.10.3.—) |
| 647 | 648 | RXA00379 | GR00082 | 212 | 6 | CYTOCHROME C-TYPE BIOGENESIS PROTEIN CCDA |
| 649 | 650 | RXA00385 | GR00083 | 773 | 435 | CYTOCHROME C-TYPE BIOGENESIS PROTEIN CCDA |
| 651 | 652 | RXA01743 | GR00494 | 806 | 6 | CYTOCHROME D UBIQUINOL OXIDASE SUBUNIT II (EC 1.10.3.—) |
| 653 | 654 | RXN02480 | VV0084 | 31222 | 29567 | CYTOCHROME C OXIDASE POLYPEPTIDE I (EC 1.9.3.1) |
| 655 | 656 | F RXA01919 | GR00550 | 288 | 4 | CYTOCHROME C OXIDASE SUBUNIT I (EC 1.9.3.1) |
| 657 | 658 | F RXA02480 | GR00717 | 1449 | 601 | CYTOCHROME C OXIDASE POLYPEPTIDE I (EC 1.9.3.1) |
| 659 | 660 | F RXA02481 | GR00717 | 1945 | 1334 | CYTOCHROME C OXIDASE POLYPEPTIDE I (EC 1.9.3.1) |
| 661 | 662 | RXA02140 | GR00639 | 7339 | 8415 | CYTOCHROME C OXIDASE POLYPEPTIDE II (EC 1.9.3.1) |
| 663 | 664 | RXA02142 | GR00639 | 9413 | 10063 | CYTOCHROME C OXIDASE POLYPEPTIDE I (EC 1.9.3.1) |

-continued

| Nucleic Acid SEQ ID NO | Amino Acid SEQ ID NO | Identification Code | Contig. | NT Start | NT Stop | Function |
|---|---|---|---|---|---|---|
| 665 | 666 | RXA02144 | GR00639 | 11025 | 12248 | RIESKE IRON-SULFUR PROTEIN |
| 667 | 668 | RXA02740 | GR00763 | 7613 | 8542 | PROBABLE CYTOCHROME C OXIDASE ASSEMBLY FACTOR |
| 669 | 670 | RXA02743 | GR00763 | 13534 | 12497 | CYTOCHROME AA3 CONTROLLING PROTEIN |
| 671 | 672 | RXA01227 | GR00355 | 1199 | 1519 | FERREDOXIN |
| 673 | 674 | RXA01865 | GR00532 | 436 | 122 | FERREDOXIN |
| 675 | 676 | RXA00680 | GR00179 | 2632 | 2315 | FERREDOXIN VI |
| 677 | 678 | RXA00679 | GR00179 | 2302 | 1037 | FERREDOXIN--NAD(+) REDUCTASE (EC 1.18.1.3) |
| 679 | 680 | RXA00224 | GR00032 | 24965 | 24015 | ELECTRON TRANSFER FLAVOPROTEIN ALPHA-SUBUNIT |
| 681 | 682 | RXA00225 | GR00032 | 25783 | 24998 | ELECTRON TRANSFER FLAVOPROTEIN BETA-SUBUNIT |
| 683 | 684 | RXN00606 | VV0192 | 11299 | 9026 | NADH DEHYDROGENASE I CHAIN L (EC 1.6.5.3) |
| 685 | 686 | F RXA00606 | GR00160 | 121 | 1869 | NADH DEHYDROGENASE I CHAIN L (EC 1.6.5.3) |
| 687 | 688 | RXN00595 | VV0192 | 8642 | 7113 | NADH DEHYDROGENASE I CHAIN M (EC 1.6.5.3) |
| 689 | 690 | F RXA00608 | GR00160 | 2253 | 3017 | NADH DEHYDROGENASE I CHAIN M (EC 1.6.5.3) |
| 691 | 692 | RXA00913 | GR00249 | 3 | 2120 | NADH DEHYDROGENASE I CHAIN L (EC 1.6.5.3) |
| 693 | 694 | RXA00909 | GR00247 | 2552 | 3406 | NADH DEHYDROGENASE I CHAIN L (EC 1.6.5.3) |
| 695 | 696 | RXA00700 | GR00182 | 846 | 43 | NADH-UBIQUINONE OXIDOREDUCTASE CHAIN 2 |
| 697 | 698 | RXN00483 | VV0086 | 44824 | 46287 | NADH-UBIQUINONE OXIDOREDUCTASE 39 KD SUBUNIT PRECURSOR (EC 1.6.5.3) (EC 1.6.99.3) |
| 699 | 700 | F RXA00483 | GR00119 | 19106 | 20569 | NADH-UBIQUINONE OXIDOREDUCTASE 39 KD SUBUNIT PRECURSOR (EC 1.6.5.3) (EC 1.6.99.3) |
| 701 | 702 | RXA01534 | GR00427 | 1035 | 547 | NADH-DEPENDENT FMN OXYDOREDUCTASE |
| 703 | 704 | RXA00288 | GR00046 | 2646 | 1636 | QUINONE OXIDOREDUCTASE (EC 1.6.5.5) |
| 705 | 706 | RXA02741 | GR00763 | 9585 | 8620 | QUINONE OXIDOREDUCTASE (EC 1.6.5.5) |
| 707 | 708 | RXN02560 | VV0101 | 9922 | 10788 | NADPH-FLAVIN OXIDOREDUCTASE (EC 1.6.99.—) |
| 709 | 710 | F RXA02560 | GR00731 | 6339 | 7160 | NADPH-FLAVIN OXIDOREDUCTASE (EC 1.6.99.—) |
| 711 | 712 | RXA01311 | GR00380 | 1611 | 865 | SUCCINATE DEHYDROGENASE IRON-SULFUR PROTEIN (EC 1.3.99.1) |
| 713 | 714 | RXN03014 | VV0058 | 1273 | 368 | NADH DEHYDROGENASE I CHAIN M (EC 1.6.5.3) |
| 715 | 716 | F RXA00910 | GR00248 | 3 | 1259 | Hydrogenase subunits |
| 717 | 718 | RXN01895 | VV0117 | 955 | 5 | NADH DEHYDROGENASE (EC 1.6.99.3) |
| 719 | 720 | F RXA01895 | GR00543 | 2 | 817 | DEHYDROGENASE |
| 721 | 722 | RXA00703 | GR00183 | 2556 | 271 | FORMATE DEHYDROGENASE ALPHA CHAIN (EC 1.2.1.2) |
| 723 | 724 | RXN00705 | VV0005 | 6111 | 5197 | FDHD PROTEIN |
| 725 | 726 | F RXA00705 | GR00184 | 1291 | 407 | FDHD PROTEIN |
| 727 | 728 | RXN00388 | VV0025 | 2081 | 3091 | CYTOCHROME C BIOGENESIS PROTEIN CCSA |
| 729 | 730 | F RXA00388 | GR00085 | 969 | 667 | essential protein similar to cytochrome c |
| 731 | 732 | F RXA00386 | GR00084 | 514 | 5 | RESC PROTEIN, essential protein similar to cytochrome c biogenesis protein |
| 733 | 734 | RXA00945 | GR00259 | 1876 | 2847 | putative cytochrome oxidase |
| 735 | 736 | RXN02556 | vv0101 | 5602 | 6759 | FLAVOHEMOPROTEIN/DIHYDROPTERIDINE REDUCTASE (EC 1.6.99.7) |
| 737 | 738 | F RXA02556 | GR00731 | 2019 | 3176 | FLAVOHEMOPROTEIN |
| 739 | 740 | RXA01392 | GR00408 | 2297 | 3373 | GLUTATHIONE S-TRANSFERASE (EC 2.5.1.18) |
| 741 | 742 | RXA00800 | GR00214 | 2031 | 3134 | GLUTATHIONE-DEPENDENT FORMALDEHYDE DEHYDROGENASE (EC 1.2.1.1) |
| 743 | 744 | RXA02143 | GR00639 | 10138 | 11025 | QCRC PROTEIN, menaquinol:cytochrome c oxidoreductase |
| 745 | 746 | RXN03096 | VV0058 | 405 | 4 | NADH DEHYDROGENASE I CHAIN M (EC 1.6.5.3) |
| 747 | 748 | RXN02036 | VV0176 | 32683 | 33063 | NADH-UBIQUINONE OXIDOREDUCTASE CHAIN 4 (EC 1.6.5.3) |
| 749 | 750 | RXN02765 | VV0317 | 3552 | 2794 | Hypothetical Oxidoreductase |
| 751 | 752 | RXN02206 | VV0302 | 1784 | 849 | Hypothetical Oxidoreductase |
| 753 | 754 | RXN02554 | VV0101 | 4633 | 4010 | Hypothetical Oxidoreductase (EC 1.1.1.—) |
| ATP-Synthase | | | | | | |
| 755 | 756 | RXN01204 | VV0121 | 1270 | 461 | ATP SYNTHASE A CHAIN (EC 3.6.1.34) |
| 757 | 758 | F RXA01204 | GR00345 | 394 | 1155 | ATP SYNTHASE A CHAIN (EC 3.6.1.34) |
| 759 | 760 | RXA01201 | GR00344 | 675 | 2315 | ATP SYNTHASE ALPHA CHAIN (EC 3.6.1.34) |
| 761 | 762 | RXN01193 | VV0175 | 5280 | 3832 | ATP SYNTHASE BETA CHAIN (EC 3.6.1.34) |
| 763 | 764 | F RXA01193 | GR00343 | 15 | 755 | ATP SYNTHASE BETA CHAIN (EC 3.6.1.34) |
| 765 | 766 | F RXA01203 | GR00344 | 3355 | 3993 | ATP SYNTHASE BETA CHAIN (EC 3.6.1.34) |
| 767 | 768 | RXN02821 | VV0121 | 324 | 85 | ATP SYNTHASE C CHAIN (EC 3.6.1.34) |
| 769 | 770 | F RXA02821 | GR00802 | 139 | 318 | ATP SYNTHASE C CHAIN (EC 3.6.1.34) |
| 771 | 772 | RXA01200 | GR00344 | 2 | 610 | ATP SYNTHASE DELTA CHAIN (EC 3.6.1.34) |
| 773 | 774 | RXA01194 | GR00343 | 770 | 1141 | ATP SYNTHASE EPSILON CHAIN (EC 3.6.1.34) |
| 775 | 776 | RXA01202 | GR00344 | 2375 | 3349 | ATP SYNTHASE GAMMA CHAIN (EC 3.6.1.34) |
| 777 | 778 | RXN02434 | VV0090 | 4923 | 3274 | ATP-BINDING PROTEIN |
| Cytochrome metabolism | | | | | | |
| 779 | 780 | RXN00684 | VV0005 | 29864 | 28581 | CYTOCHROME P450 116 (EC 1.14.—.—) |
| 781 | 782 | RXN00387 | VV0025 | 1150 | 2004 | Hypothetical Cytochrome c Biogenesis Protein |

TABLE 2

GENES IDENTIFIED FROM GENBANK

| GenBank™ Accession No. | Gene Name | Gene Function | Reference |
|---|---|---|---|
| A09073 | ppg | Phosphoenol pyruvate carboxylase | Bachmann, B. et al. "DNA fragment coding for phosphoenolpyruvat corboxylase, recombinant DNA carrying said fragment, strains carrying the recombinant DNA and method for producing L-aminino acids using said strains," Patent: EP 0358940-A 3 Mar. 21, 1990 |
| A45579, A45581, A45583, A45585 A45587 | | Threonine dehydratase | Moeckel, B. et al. "Production of L-isoleucine by means of recombinant micro-organisms with deregulated threonine dehydratase," Patent: WO 9519442-A 5 Jul. 20, 1995 |
| AB003132 | murC; ftsQ; ftsZ | | Kobayashi, M. et al. "Cloning, sequencing, and characterization of the ftsZ gene from *coryneform bacteria*," Biochem. Biophys. Res. Commun., 236(2):383-388 (1997) |
| AB015023 | murC; ftsQ | | Wachi, M. et al. "A murC gene from *Coryneform bacteria*," Appl. Microbiol. Biotechnol., 51(2):223-228 (1999) |
| AB018530 | dtsR | | Kimura, E. et al. "Molecular cloning of a novel gene, dtsR, which rescues the detergent sensitivity of a mutant derived from *Brevibacterium lactofermentum*," Biosci. Biotechnol. Biochem., 60(10):1565-1570 (1996) |
| AB018531 | dtsR1; dtsR2 | | |
| AB020624 | murI | D-glutamate racemase | |
| AB023377 | tkt | transketolase | |
| AB024708 | gltB; gltD | Glutamine 2-oxoglutarate aminotransferase large and small subunits | |
| AB025424 | acn | aconitase | |
| AB027714 | rep | Replication protein | |
| AB027715 | rep; aad | Replication protein; aminoglycoside adenyltransferase | |
| AF005242 | argC | N-acetylglutamate-5-semialdehyde dehydrogenase | |
| AF005635 | glnA | Glutamine synthetase | |
| AF030405 | hisF | cyclase | |
| AF030520 | argG | Argininosuccinate synthetase | |
| AF031518 | argF | Ornithine carbamolytransferase | |
| AF036932 | aroD | 3-dehydroquinate dehydratase | |
| AF038548 | pyc | Pyruvate carboxylase | |
| AF038651 | dciAE; apt; rel | Dipeptide-binding protein; adenine phosphoribosyltransferase; GTP pyrophosphokinase | Wehmeier, L. et al. "The role of the *Corynebacterium glutamicum* rel gene in (p)ppGpp metabolism," Microbiology, 144:1853-1862 (1998) |
| AF041436 | argR | Arginine repressor | |
| AF045998 | impA | Inositol monophosphate phosphatase | |
| AF048764 | argH | Argininosuccinate lyase | |
| AF049897 | argC; argJ; argB; argD; argF; argR; argG; argH | N-acetylglutamylphosphate reductase; ornithine acetyltransferase; N-acetylglutamate kinase; acetylornithine transminase; ornithine carbamoyltransferase; arginine repressor; argininosuccinate synthase; argininosuccinate lyase | |
| AF050109 | inhA | Enoyl-acyl carrier protein reductase | |
| AF050166 | hisG | ATP phosphoribosyltransferase | |
| AF051846 | hisA | Phosphoribosylformimino-5-amino-1-phosphoribosyl-4-imidazolecarboxamide isomerase | |
| AF052652 | metA | Homoserine O-acetyltransferase | Park, S. et al. "Isolation and analysis of metA, a methionine biosynthetic gene encoding homoserine acetyltransferase in *Corynebacterium glutamicum*," Mol. Cells., 8(3):286-294 (1998) |
| AF053071 | aroB | Dehydroquinate synthetase | |
| AF060558 | hisH | Glutamine amidotransferase | |
| AF086704 | hisE | Phosphoribosyl-ATP-pyrophosphohydrolase | |
| AF114233 | aroA | 5-enolpyruvylshikimate-3-phosphate synthase | |
| AF116184 | panD | L-aspartate-alpha-decarboxylase precursor | Dusch, N. et al. "Expression of the *Corynebacterium glutamicum* panD gene encoding L-aspartate-alpha-decarboxylase leads to pantothenate overproduction in *Escherichia coli*," Appl. Environ. Microbiol., 65(4)1530-1539 (1999) |
| AF124518 | aroD; aroE | 3-dehydroquinase; shikimate dehydrogenase | |

TABLE 2-continued

GENES IDENTIFIED FROM GENBANK

| GenBank™ Accession No. | Gene Name | Gene Function | Reference |
|---|---|---|---|
| AF124600 | aroC; aroK; aroB; pepQ | Chorismate synthase; shikimate kinase; 3-dehydroquinate synthase; putative cytoplasmic peptidase | |
| AF145897 | inhA | | |
| AF145898 | inhA | | |
| AJ001436 | ectP | Transport of ectoine, glycine betaine, proline | Peter, H. et al. "*Corynebacterium glutamicum* is equipped with four secondary carriers for compatible solutes: Identification, sequencing, and characterization of the proline/ectoine uptake system, ProP, and the ectoine/proline/glycine betaine carrier, EctP," J. Bacteriol., 180(22):6005-6012 (1998) |
| AJ004934 | dapD | Tetrahydrodipicolinate succinylase (incomplete[i]) | Wehrmann, A. et al. "Different modes of diaminopimelate synthesis and their role in cell wall integrity: A study with *Corynebacterium gutamicum*," J. Bacteriol., 180(12):3159-3165 (1998) |
| AJ007732 | ppc; secG; amt; ocd; soxA | Phosphoenolpyruvate-carboxylase; ?; high affinity ammonium uptake protein; putative ornithine-cyclodecarboxylase; sarcosine oxidase | |
| AJ010319 | ftsY, glnB, glnD; srp; amtP | Involved in cell division; PII protein; uridylyltransferase (uridylyl-removing enzyme); signal recognition particle; low affinity ammonium uptake protein | Jakoby, M. et al. "Nitrogen regulation in *Corynebacterium glutamicum*; Isolation of genes involved in biochemical characterization of corresponding proteins," FEMS Microbiol., 173(2):303-310 (1999) |
| AJ132968 | cat | Chloramphenicol aceteyl transferase | |
| AJ224946 | mqo | L-malate: quinone oxidoreductase | Molenaar, D. et al. "Biochemical and genetic characterization of the membrane-associate malate dehydrogenase (acceptor) from *Corynebacterium glutamicum*," Eur. J. Biochem., 254(2):395-403 (1998) |
| AJ238250 | ndh | NADH dehydrogenase | |
| AJ238703 | porA | Porin | Lichtinger, T. et al. "Biochemical and biophysical characterization of the cell wall porin of *Corynebacterium glutamicum*: The channel is formed by a low molecular mass polypeptide," Biochemistry, 37(43):15024-15032 (1998) |
| D17429 | | Transposable element IS31831 | Vertes, A. A. et al. "Isolation and characterization of IS31831, a transposable element from *Corynebacterium glutamicum*," Mol. Microbiol., I1(4):739-746 (1994) |
| D84102 | odhA | 2-oxoglutarate dehydrogenase | Usuda, Y. et al. "Molecular cloning of the *Corynebacterium glutamicum* (*Brevibacterium lactofermentum* AJ12036) odhA gene encoding a novel type of 2-oxoglutarate dehydrogenase," Microbiology, 142:3347-3354 (1996) |
| E01358 | hdh; hk | Homoserine dehydrogenase; homoserine kinase | Katsumata, R. et al. "Production of L-thereonine and L-isoleucine," Patent: JP 1987232392-A 1 Oct. 12, 1987 |
| E01359 | | Upstream of the start codon of homoserine kinase gene | Katsumata, R. et al. "Production of L-thereonine and L-isoleucine," Patent: JP 1987232392-A Oct. 12, 1987 |
| E01375 | | Tryptophan operon | |
| E01376 | trpL; trpE | Leader peptide; anthranilate synthase | Matsui, K. et al. "Tryptophan operon, peptide and protein coded thereby, utilization of tryptophan operon gene expression and production of tryptophan," Patent: JP 1987244382-A 1 Oct. 24, 1987 |
| E01377 | | Promoter and operator regions of tryptophan operon | Matsui, K. et al. "Tryptophan operon, peptide and protein coded thereby, utilization of tryptophan operon gene expression and production of tryptophan," Patent: JP 1987244382-A 1 Oct. 24, 1987 |
| E03937 | | Biotin-synthase | Hatakeyama, K. et al. "DNA fragment containing gene capable of coding biotin synthetase and its utilization," Patent: JP 1992278088-A 1 Oct. 2, 1992 |
| E04040 | | Diamino pelargonic acid aminotransferase | Kohama, K. et al. "Gene coding diaminopleargonic acid aminotransferase and desthiobiotin synthetase and its utilization," Patent: JP 1992330284-A 1 Nov. 18, 1992 |
| E04041 | | Desthiobiotinsynthetase | Kohama, K. et al. "Gene coding diaminopelargonic acid aminotransferase and desthiobiotin synthetase and its utilization," Patent: JP 1992330284-A 1 Nov. 18, 1992 |
| E04307 | | Flavum aspartase | Kurusu, Y. et al. "Gene DNA coding aspartase and utilization thereof," Patent: JP 1993030977-A 1 Feb. 9, 1993 |
| E04376 | | Isocitric acid lyase | Katsumata, R. et al. "Gene manifestation controlling DNA," Patent: JP 1993056782-A 3 Mar. 9, 1993 |
| E04377 | | Isocitric acid lyase N-terminal fragment | Katsumata, R. et al. "Gene manifestation controlling DNA," Patent: JP 1993056782-A 3 Mar. 9, 1993 |
| E04484 | | Prephenate dehydratase | Sotouchi, N. et al. "Production of L-phenylalanine by fermentation," Patent: JP 1993076352-A 2 Mar. 30, 1993 |
| E05108 | | Aspartokinase | Fugono, N. et al. "Gene DNA coding Aspartokinase and its use," Patent: JP 1993184366-A 1 Jul. 27, 1993 |

TABLE 2-continued

GENES IDENTIFIED FROM GENBANK

| GenBank™ Accession No. | Gene Name | Gene Function | Reference |
|---|---|---|---|
| E05112 | | Dihydro-dipichorinate synthetase | Hatakyama, K. et al. "Gene DNA coding dihydrodipicolinic acid synthetase and its use," Patent: JP 1993184371-A 1 Jul. 27, 1993 |
| E05776 | | Diaminopimelic acid dehydrogenase | Kobayashi, M. et al. "Gene DNA coding Diaminopimelic acid dehydrogenase and its use," Patent: JP 1993284970-A 1 Nov. 2, 1993 |
| E05779 | | Threonine synthase | Kohama, K. et al. "Gene DNA coding threonine synthase and its use," Patent: JP 1993284972-A 1 Nov. 2, 1993 |
| E06110 | | Prephenate dehydratase | Kikuchi, T. et al. "Production of L-phenylalanine by fermentation method," Patent: JP 1993344881-A 1 Dec. 27, 1993 |
| E06111 | | Mutated Prephenate dehydratase | Kikuchi, T. et al. "Production of L-phenylalanine by fermentation method," Patent: JP 1993344881-A 1 Dec. 27, 1993 |
| E06146 | | Acetohydroxy acid synthetase | Inui, M. et al. "Gene capable of coding Acetohydroxy acid synthetase and its use," Patent: JP 1993344893-A 1 Dec. 27, 1993 |
| E06825 | | Aspartokinase | Sugimoto, M. et al. "Mutant aspartokinase gene," patent: JP 1994062866-A 1 Mar. 8, 1994 |
| E06826 | | Mutated aspartokinase alpha subunit | Sugimoto, M. et al. "Mutant aspartokinase gene," patent: JP 1994062866-A 1 Mar. 8, 1994 |
| E06827 | | Mutated aspartokinase alpha subunit | Sugimoto, M. et al. "Mutant aspartokinase gene," patent: JP 1994062866-A 1 Mar. 8, 1994 |
| E07701 | secY | | Honno, N. et al. "Gene DNA participating in integration of membraneous protein to membrane," Patent: JP 1994169780-A 1 Jun. 21, 1994 |
| E08177 | | Aspartokinase | Sato, Y. et al. "Genetic DNA capable of coding Aspartokinase released from feedback inhibition and its utilization," Patent: JP 1994261766-A 1 Sep. 20, 1994 |
| E08178, E08179, E08180, E08181, E08182 | | Feedback inhibition-released Aspartokinase | Sato, Y. et al. "Genetic DNA capable of coding Aspartokinase released from feedback inhibition and its utilization," Patent: JP 1994261766-A 1 Sep. 20, 1994 |
| E08232 | | Acetohydroxy-acid isomeroreductase | Inui, M. et al. "Gene DNA coding acetohydroxy acid isomeroreductase," Patent: JP 1994277067-A 1 Oct. 4, 1994 |
| E08234 | secE | | Asai, Y. et al. "Gene DNA coding for translocation machinery of protein," Patent: JP 1994277073-A 1 Oct. 4, 1994 |
| E08643 | | FT aminotransferase and desthiobiotin synthetase promoter region | Hatakeyama, K. et al. "DNA fragment having promoter function in coryneform bacterium," Patent: JP 1995031476-A 1 Feb. 3, 1995 |
| E08646 | | Biotin synthetase | Hatakeyama, K. et al. "DNA fragment having promoter function in coryneform bacterium," Patent: JP 1995031476-A 1 Feb. 3, 1995 |
| E08649 | | Aspartase | Kohama, K. et al. "DNA fragment having promoter function in coryneform bacterium," Patent: JP 1995031478-A 1 Feb. 3, 1995 |
| E08900 | | Dihydrodipicolinate reductase | Madori, M. et al. "DNA fragment containing gene coding Dihydrodipicolinate acid reductase and utilization thereof," Patent: JP 1995075578-A 1 Mar. 20, 1995 |
| E08901 | | Diaminopimelic acid decarboxylase | Madori, M. et al. "DNA fragment containing gene coding Diaminopimelic acid decarboxylase and utilization thereof," Patent: JP 1995075579-A 1 Mar. 20, 1995 |
| E12594 | | Serine hydroxymethyltransferase | Hatakeyama, K. et al. "Production of L-trypophan," Patent: JP 1997028391-A 1 Feb. 4, 1997 |
| E12760, E12759 E12758, | | transposase | Moriya, M. et al. "Amplification of gene using artificial transposon," Patent: JP 1997070291-A Mar. 18, 1997 |
| E12764 | | Arginyl-tRNA synthetase; diaminopimelic acid decarboxylase | Moriya, M. et al. "Amplification of gene using artificial transposon," Patent: JP 1997070291-A Mar. 18, 1997 |
| E12767 | | Dihydrodipicolinic acid synthetase | Moriya, M. et al. "Amplification of gene using artificial transposon," Patent: JP 1997070291-A Mar. 18, 1997 |
| E12770 | | aspartokinase | Moriya, M. et al. "Amplification of gene using artificial transposon," Patent: JP 1997070291-A Mar. 18, 1997 |
| E12773 | | Dihydrodipicolinic acid reductase | Moriya, M. et al. "Amplification of gene using artificial transposon," Patent: JP 1997070291-A Mar. 18, 1997 |
| E13655 | | Glucose-6-phosphate dehydrogenase | Hatakeyama, K. et al. "Glucose-6-phosphate dehydrogenase and DNA capable of coding the same," Patent: JP 1997224661-A 1 Sep. 2, 1997 |
| L01508 | IlvA | Threonine dehydratase | Moeckel, B. et al. "Functional and structural analysis of the threonine dehydratase of Corynebacterium glutamicum," J. Bacteriol., 174:8065-8072 (1992) |

TABLE 2-continued

GENES IDENTIFIED FROM GENBANK

| GenBank™ Accession No. | Gene Name | Gene Function | Reference |
|---|---|---|---|
| L07603 | EC 4.2.1.15 | 3-deoxy-D-arabinoheptulosonate-7-phosphate synthase | Chen, C. et al. "The cloning and nucleotide sequence of *Corynebacterium glutamicum* 3-deoxy-D-arabinoheptulosonate-7-phosphate synthase gene," FEMS Microbiol. Let., 107:223-230 (1993) |
| L09232 | IlvB; ilvN; ilvC | Acetohydroxy acid synthase large subunit; Acetohydroxy acid synthase small subunit; Acetohydroxy acid isomeroreductase | Keilhauer, C. et al. "Isoleucine synthesis in *Corynebacterium glutamicum*: molecular analysis of the ilvB-ilvN-ivlC operon," J. Bacteriol., 175(17):5595-5603 (1993) |
| L18874 | PtsM | Phosphoenolpyruvate sugar phosphotransferase | Fouet, A et al. "*Bacillus subtilis* sucrose-specific enzyme II of the phosphotransferase system: expression in *Escherichia coli* and homology to enzymes II from enteric bacteria," PNAS USA, 84(24):8773-8777 (1987); Lee, J. K. et al. "Nucleotide sequence of the gene encoding the *Corynebacterium glutamicum* mannose enzyme II and analyses of the deduced protein sequence," FEMS Microbiol. Lett., 119(1-2):137-145 (1994) |
| L27123 | aceB | Malate synthase | Lee, H-S. et al. "Molecular characterization of aceB, a gene encoding malate synthase in *Corynebacterium glutamicum*," J. Microbiol. Biotechnol., 4(4):256-263 (1994) |
| L27126 | | Pyruvate kinase | Jetten, M. S. et al. "Structural and functional analysis of pyruvate kinase from *Corynebacterium glutamicum*," Appl. Environ. Microbiol., 60(7):2501-2507 (1994) |
| L28760 | aceA | Isocitrate lyase | |
| L35906 | dtxr | Diphtheria toxin repressor | Oguiza, J. A. et al. "Molecular cloning, DNA sequence analysis, and characterization of the *Corynebacterium diphtheriae* dtxR from *Brevibacterium lactofermentum*," J. Bacteriol., 177(2):465-467 (1995) |
| M13774 | | Prephenate dehydratase | Follettie, M. T. et al. "Molecular cloning and nucleotide sequence of the *Corynebacterium glutamicum* pheA gene," J. Bacteriol., 167:695-702 (1986) |
| M16175 | 5S rRNA | | Park, Y-H. et al. "Phylogenetic analysis of the *coryneform* bacteria by 5S rRNA sequences," J. Bacteriol., 169:1801-1806 (1987) |
| M16663 | trpE | Anthranilate synthase, 5' end | Sano, K. et al. "Structure and function of the trp operon control regions of *Brevibacterium lactofermentum*, a glutamic-acid producing bacterium," Gene, 52:191-200 (1987) |
| M16664 | trpA | Tryptophan synthase, 3' end | Sano, K. et al. "Structure and function of the trp operon control regions of *Brevibacterium lactofermentum*, a glutamic-acid-producing bacterium," Gene, 52:191-200 (1987) |
| M25819 | | Phosphoenolpyruvate carboxylase | O'Regan, M. et al. "Cloning and nucleotide sequence of the Phosphoenolpyruvate carboxylase-coding gene of *Corynebacterium glutamicum* ATCC13032," Gene, 77(2):237-251 (1989) |
| M85106 | | 23S rRNA gene insertion sequence | Roller, C. et al. "Gram-positive bacteria with a high DNA G + C content are characterized by a common insertion within their 23S rRNA genes," J. Gen. Microbiol., 138:1167-1175 (1992) |
| M85107, M85108 | | 23S rRNA gene insertion sequence | Roller, C. et al. "Gram-positive bacteria with a high DNA G + C content are characterized by a common insertion within their 23S rRNA genes," J. Gen. Microbiol., 138:1167-1175 (1992) |
| M89931 | aecD; brnQ; yhbw | Beta C-S lyase; branched-chain amino acid uptake carrier; hypothetical protein yhbw | Rossol, I. et al. "The *Corynebacterium glutamicum* aecD gene encodes a C-S lyase with alpha, beta-elimination activity that degrades aminoethylcysteine," J. Bacteriol., 174(9):2968-2977 (1992); Tauch, A. et al. "Isoleucine uptake in *Corynebacterium glutamicum* ATCC 13032 is directed by the brnQ gene product," Arch. Microbiol., 169(4):303-312 (1998) |
| S59299 | trp | Leader gene (promoter) | Herry, D. M. et al. "Cloning of the trp gene cluster from a tryptophan-hyperproducing strain of *Corynebacterium glutamicum*: identification of a mutation in the trp leader sequence," Appl. Environ. Microbiol., 59(3):791-799 (1993) |
| U11545 | trp D | Anthranilate phosphoribosyltransferase | O'Gara, J. P. and Dunican, L. K. (1994) Complete nucleotide sequence of the *Corynebacterium glutamicum* ATCC 21850 tpD gene." Thesis, Microbiology Department, University College Galway, Ireland. |
| U13922 | cglIM; cglIR; clgIIR | Putative type II 5-cytosoine methyltransferase; putative type II restriction endonuclease; putative type I or type III restriction endonuclease | Schafer, A. et al. "Cloning and characterization of a DNA region encoding a stress-sensitive restriction system from *Corynebacterium glutamicum* ATCC 13032 and analysis of its role in intergeneric conjugation with *Escherichia coli*," J. Bacteriol., 176(23):7309-7319 (1994); Schafer, A. et al. "The *Corynebacterium glutamicum* cglIM gene encoding a 5-cytonsine in an McrBC-deficient *Escherichia coli* strain," Gene, 203(2):95-101 (1997) |
| U14965 | recA | | |

TABLE 2-continued

GENES IDENTIFIED FROM GENBANK

| GenBank ™ Accession No. | Gene Name | Gene Function | Reference |
|---|---|---|---|
| U31224 | ppx | | Ankri, S. et al. "Mutations in the *Corynebacterium glutamicum* proline biosynthetic pathway: A natural bypass of the proA step," J. Bacteriol., 178(15):4412-4419 (1996) |
| U31225 | proC | L-proline; NADP + 5-oxidoreductase | Ankri, S. et al. "Mutations in the *Corynebacterium glutamicum* proline biosynthetic pathway: A natural bypass of the proA step," J. Bacteriol., 178(15):4412-4419 (1996) |
| U31230 | obg; proB; unkdh | ?; gamma glutamyl kinase; similar to D-isomer specific 2-hydroxyacid dehydrogenases | Ankri, S. et al. "Mutations in the *Corynebacterium glutamicum* proline biosynthetic pathway: A natural bypass of the proA step," J. Bacteriol., 178(15):4412-4419 (1996) |
| U31281 | bioB | Biotin synthase | Serebriiskii, I. G., "Two new members of the bio B superfamily: Cloning, sequencing and expression of bio B genes of *Methylobacillus flagellatum* and *Corynebacterium glutamicum*," Gene, 175:15-22 (1996) |
| U35023 | thtR; accBC | Thiosulfate sulfurtransferase; acyl CoA carboxylase | Jager, W. et al. "A *Corynebacterium glutamicum* gene encoding a two-domain protein similar to biotin carboxylases and biotin-carboxyl-carrier proteins," Arch. Microbiol., 166(2):76-82 (1996) |
| U43535 | cmr | Multidrug resistance protein | Jager, W. et al. "A *Corynebacterium glutamicum* gene conferring multidrug resistance in the heterologous host *Escherichia coli*," J. Bacteriol., 179(7):2449-2451 (1997) |
| U43536 | clpB | Heat shock ATP-binding protein | |
| U53587 | aphA-3 | 3'5"-aminoglycoside phosphotransferase | |
| U89648 | | *Corynebacterium glutamicum* unidentified sequence involved in histidine biosynthesis, partial sequence | |
| X04960 | trpA; trpB; trpC; trpD; trpE; trpG; trpL | Tryptophan operon | Matsui, K. et al. "Complete nucleotide and deduced amino acid sequences of the *Brevibacterium lactofermentum* tryptophan operon," Nucleic Acids Res., 14(24):10113-10114 (1986) |
| X07563 | lys A | DAP decarboxylase (meso-diaminopimelate decarboxylase, EC 4.1.1.20) | Yeh, P. et al. "Nucleic sequence of the lysA gene of *Corynebacterium glutamicum* and possible mechanisms for modulation of its expression," Mol. Gen. Genet., 212(1):112-119 (1988) |
| X14234 | EC 4.1.1.31 | Phosphoenolpyruvate carboxylase | Eikmanns, B. J. et al. "The Phosphoenolpyruvate carboxylase gene of *Corynebacterium glutamicum*: Molecular cloning, nucleotide sequence, and expression," Mol. Gen. Genet., 218(2):330-339 (1989); Lepiniec, L. et al. "Sorghum Phosphoenolpyruvate carboxylase gene family: structure, function and molecular evolution," Plant. Mol. Biol., 21(3):487-502 (1993) |
| X17313 | fda | Fructose-bisphosphate aldolase | Von der Osten, C. H. et al. "Molecular cloning, nucleotide sequence and fine-structural analysis of the *Corynebacterium glutamicum* fda gene: structural comparison of *C. glutamicum* fructose-1, 6-biphosphate aldolase to class I and class II aldolases," Mol. Microbiol. |
| X53993 | dapA | L-2, 3-dihydrodipicolinate synthetase (EC 4.2.1.52) | Bonnassie, S. et al. "Nucleic sequence of the dapA gene from *Corynebacterium glutamicum*," Nucleic Acids Res., 18(21):6421 (1990) |
| X54223 | | AttB-related site | Cianciotto, N. et al. "DNA sequence homology between att B-related sites of *Corynebacterium diphtheriae*, *Corynebacterium ulcerans*, *Corynebacterium glutamicum*, and the attP site of lambdacorynephage," FEMS. Microbiol, Lett., 66:299-302 (1990) |
| X54740 | argS; lysA | Arginyl-tRNA synthetase; Diaminopimelate decarboxylase | Marcel, T. et al. "Nucleotide sequence and organization of the upstream region of the *Corynebacterium glutamicum* lysA gene," Mol. Microbiol., 4(11):1819-1830 (1990) |
| X55994 | trpL; trpE | Putative leader peptide; anthranilate synthase component I | Heery, D. M. et al. "Nucleotide sequence of the *Corynebacterium glutamicum* trpE gene," Nucleic Acids Res., 18(23):7138 (1990) |
| X56037 | thrC | Threonine synthase | Han, K. S. et al. "The molecular structure of the *Corynebacterium glutamicum* threonine synthase gene," Mol. Microbiol., 4(10):1693-1702 (1990) |
| X56075 | attB-related site | Attachment site | Cianciotto, N. et al. "DNA sequence homology between att B-related sites of *Corynebacterium diphtheriae*, *Corynebacterium ulcerans*, *Corynebacterium glutamicum*, and the attP site of lambdacorynephage," FEMS. Microbiol, Lett., 66:299-302 (1990) |
| X57226 | lysC-alpha; lysC-beta; asd | Aspartokinase-alpha subunit; Aspartokinase-beta subunit; aspartate beta semialdehyde dehydrogenase | Kalinowski, J. et al. "Genetic and biochemical analysis of the Aspartokinase from *Corynebacterium glutamicum*," Mol Microbiol., 5(5):1197-1204 (1991); Kalinowski, J. et al. "Aspartokinase genes lysC alpha and lysC beta overlap and are adjacent to the aspertate beta-semialdehyde dehydrogenase gene asd in *Corynebacterium glutamicum*," Mol. Gen. Genet., 224(3):317-324 (1990) |

TABLE 2-continued

GENES IDENTIFIED FROM GENBANK

| GenBank™ Accession No. | Gene Name | Gene Function | Reference |
| --- | --- | --- | --- |
| X59403 | gap; pgk; tpi | Glyceraldehyde-3 phosphate; phosphoglycerate kinase; triosephosphate isomerase | Eikmanns, B. J. "Identification, sequence analysis, and expression of a *Corynebacterium glutamicum* gene cluster encoding the three glycolytic enzymes glyceraldehyde-3-phosphate dehydrogenase, 3-phosphoglycerate kinase, and triosephosphate isomeras," J. Bacteriol., 174(19):6076-6086 (1992) |
| X59404 | gdh | Glutamate dehydrogenase | Bormann, E. R. et al. "Molecular analysis of the *Corynebacterium glutamicum* gdh gene encoding glutamate dehydrogenase," Mol. Microbiol., 6(3):317-326 (1992) |
| X60312 | lysI | L-lysine permease | Seep-Feldhaus, A. H. et al. "Molecular analysis of the *Corynebacterium glutamicum* lysI gene involved in lysine uptake," Mol. Microbiol., 5(12):2995-3005 (1991) |
| X66078 | cop1 | Ps1 protein | Joliff, G. et al. "Cloning and nucleotide sequence of the csp1 gene encoding PS1, one of the two major secreted proteins of *Corynebacterium glutamicum*: The deduced N-terminal region of PS1 is similar to the *Mycobacterium* antigen 85 complex," Mol. Microbiol., 6(16):2349-2362 (1992) |
| X66112 | glt | Citrate synthase | Eikmanns, B. J. et al. "Cloning sequence, expression and transcriptional analysis of the *Corynebacterium glutamicum* gltA gene encoding citrate synthase," Microbiol., 140:1817-1828 (1994) |
| X67737 | dapB | Dihydrodipicolinate reductase | |
| X69103 | csp2 | Surface layer protein PS2 | Peyret, J. L. et al. "Characterization of the cspB gene encoding PS2, an ordered surface-layer protein in *Corynebacterium glutamicum*," Mol. Microbiol., 9(1):97-109 (1993) |
| X69104 | | IS3 related insertion element | Bonamy, C. et al. "Identification of IS1206, a *Corynebacterium glutamicum* IS3-related insertion sequence and phylogenetic analysis," Mol. Microbiol., 14(3):571-581 (1994) |
| X70959 | leuA | Isopropylmalate synthase | Patek, M. et al. "Leucine synthesis in *Corynebacterium glutamicum*: enzyme activities, structure of leuA, and effect of leuA inactivation on lysine synthesis," Appl. Environ. Microbiol., 60(1):133-140 (1994) |
| X71489 | icd | Isocitrate dehydrogenase (NADP+) | Eikmanns, B. J. et al. "Cloning sequence analysis, expression, and inactivation of the *Corynebacterium glutamicum* icd gene encoding isocitrate dehydrogenase and biochemical characterization of the enzyme," J. Bacteriol., 177(3):774-782 (1995) |
| X72855 | GDHA | Glutamate dehydrogenase (NADP+) | |
| X75083, X70584 | mtrA | 5-methyltryptophan resistance | Heery, D. M. et al. "A sequence from a tryptophan-hyperproducing strain of *Corynebacterium glutamicum* encoding resistance to 5-methyltryptophan Biochem. Biophys. Res. Commun., 201(3):1255-1262 (1994) |
| X75085 | recA | | Fitzpatrick, R. et al. "Construction and characterization of recA mutant strains of *Corynebacterium glutamicum* and *Brevibacterium lactofermentum*," Appl. Microbiol. Biotechnol., 42(3):575-580 (1994) |
| X75504 | aceA; thiX | Partial Isocitrate lyase; ? | Reinscheid, D. J. et al. "Characterization of the isocitrate lyase gene from *Corynebacterium glutamicum* and biochemical analysis of the enzyme," J. Bacteriol., 176(12):3474-3483 (1994) |
| X76875 | | ATPase beta-subunit | Ludwig, W. et al. "Phylogenetic relationships of bacteria based on comparative sequence analysis of elongation factor Tu and ATP-synthase beta-subunit genes," Antonie Van Leeuwenhoek, 64:285-305 (1993) |
| X77034 | tuf | Elongation factor Tu | Ludwig, W. et al. "Phylogenetic relationships of bacteria based on comparative sequence analysis of elongation factor Tu and ATP-synthase beta-subunit genes," Antonie Van Leeuwenhoek, 64:285-305 (1993) |
| X77384 | recA | | Billman-Jacobe, H. "Nucleotide sequence of a recA gene from *Corynebacterium glutamicum*," DNA Seq., 4(6):403-404 (1994) |
| X78491 | aceB | Malate synthase | Reinscheid, D. J. et al. "Malate synthase from *Corynebacterium glutamicum* pta-ack operon encoding phosphotransacetylase: sequence analysis," Microbiology, 140:3099-3108 (1994) |
| X80629 | 16S rDNA | 16S ribosoma RNA | Rainey, F. A. et al. "Phylogenetic analysis of the genera *Rhodococcus* and *Norcardia* and evidence for the evolutionary origin of the genus *Norcardia* from within the radiation of *Rhodococcus* species," Microbiol., 141:523-528 (1995) |

TABLE 2-continued

GENES IDENTIFIED FROM GENBANK

| GenBank™ Accession No. | Gene Name | Gene Function | Reference |
|---|---|---|---|
| X81191 | gluA; gluB; gluC; gluD | Glutamate uptake system | Kronemeyer, W. et al. "Structure of the gluABCD cluster encoding the glutamate uptake system of *Corynebacterium glutamicum*," J. Bacteriol., 177(5):1152-1158 (1995) |
| X81379 | dapE | Succinyldiaminopimelate desuccinylase | Wehrmann, A. et al. "Analysis of different DNA fragments of *Corynebacterium glutamicum* complementing dapE of *Escherichia coli*," Microbiology, 40:3349-56 (1994) |
| X82061 | 16S rDNA | 16S ribosomal RNA | Ruimy, R. et al. "Phylogeny of the genus *Corynebacterium* deduced from analyses of small-subunit ribosomal DNA sequences," Int. J. Syst. Bacteriol., 45(4):740-746 (1995) |
| X82928 | asd; lysC | Aspartate-semialdehyde dehydrogenase; ? | Serebrijski, I. et al. "Multicopy suppression by asd gene and osmotic stress-dependent complementation by heterologous proA in proA mutants," J. Bacteriol., 177(24):7255-7260 (1995) |
| X82929 | proA | Gamma-glutamyl phosphate reductase | Serebrijski, I. et al. "Multicopy suppression by asd gene and osmotic stress-dependent complementation by heterologous proA in proA mutants," J. Bacteriol., 177(24):7255-7260 (1995) |
| X84257 | 16S rDNA | 16S ribosomal RNA | Pascual, C. et al. "Phylogenetic analysis of the genus *Corynebacterium* based on 16S rRNA gene sequences," Int. J. Syst. Bacteriol., 45(4):724-728 (1995) |
| X85965 | aroP; dapE | Aromatic amino acid permease; ? | Wehrmann, A. et al. "Functional analysis of sequences adjacent to dapE of *Corynebacterium glutamicumproline* reveals the presence of aroP, which encodes the aromatic amino acid transporter," J. Bacteriol., 177(20):5991-5993 (1995) |
| X86157 | argB; argC; argD; argF; argJ | Acetylglutamate kinase; N-acetyl-gamma-glutamyl-phosphate reductase; acetylornithine aminotransferase; ornithine carbamoyltransferase; glutamate N-acetyltransferase | Sakanyan, V. et al. "Genes and enzymes of the acetyl cycle of arginine biosynthesis in *Corynebacterium glutamicum*: enzyme evolution in the early steps of the arginine pathway," Microbiology, 142:99-108 (1996) |
| X89084 | pta; ackA | Phosphate acetyltransferase; acetate kinase | Reinscheid, D. J. et al. "Cloning, sequence analysis, expression and inactivation of the *Corynebacterium* glutamicum pta-ack operon encoding phosphotransacetylase and acetate kinase," Microbiology, 145:503-513 (1999) |
| X89850 | attB | Attachment site | Le Marrec, C. et al. "Genetic characterization of site-specific integration functions of phi AAU2 infecting "*Arthrobacter aureus* C70," J. Bacteriol., 178(7): 1996-2004 (1996) |
| X90356 |  | Promoter fragment F1 | Patek, M. et al. "Promoters from *Corynebacterium glutamicum*: cloning, molecular analysis and search for a consensus motif," Microbiology, 142:1297-1309 (1996) |
| X90357 |  | Promoter fragment F2 | Patek, M. et al. "Promoters from *Corynebacterium glutamicum*: cloning, molecular analysis and search for a consensus motif," Microbiology, 142:1297-1309 (1996) |
| X90358 |  | Promoter fragment F10 | Patek, M. et al. "Promoters from *Corynebacterium glutamicum*: cloning, molecular analysis and search for a consensus motif," Microbiology, 142:1297-1309 (1996) |
| X90359 |  | Promoter fragment F13 | Patek, M. et al. "Promoters from *Corynebacterium glutamicum*: cloning, molecular analysis and search for a consensus motif," Microbiology, 142:1297-1309 (1996) |
| X90360 |  | Promoter fragment F22 | Patek, M. et al. "Promoters from *Corynebacterium glutamicum*: cloning, molecular analysis and search for a consensus motif," Microbiology, 142:1297-1309 (1996) |
| X90361 |  | Promoter fragment F34 | Patek, M. et al. "Promoters from *Corynebacterium glutamicum*: cloning, molecular analysis and search for a consensus motif," Microbiology, 142:1297-1309 (1996) |
| X90362 |  | Promoter fragment F37 | Patek, M. et al. "Promoters from *Corynebacterium glutamicum*: cloning, molecular analysis and search for a consensus motif," Microbiology, 142:1297-1309 (1996) |
| X90363 |  | Promoter fragment F45 | Patek, M. et al. "Promoters from *Corynebacterium glutamicum*: cloning, molecular analysis and search for a consensus motif," Microbiology, 142:1297-1309 (1996) |
| X90364 |  | Promoter fragment F64 | Patek, M. et al. "Promoters from *Corynebacterium glutamicum*: cloning, molecular analysis and search for a consensus motif," Microbiology, 142:1297-1309 (1996) |
| X90365 |  | Promoter fragment F75 | Patek, M. et al. "Promoters from *Corynebacterium glutamicum*: cloning, molecular analysis and search for a consensus motif," Microbiology, 142:1297-1309 (1996) |
| X90366 |  | Promoter fragment PF101 | Patek, M. et al. "Promoters from *Corynebacterium glutamicum*: cloning, molecular analysis and search for a consensus motif," Microbiology, 142:1297-1309 (1996) |
| X90367 |  | Promoter fragment PF104 | Patek, M. et al. "Promoters from *Corynebacterium glutamicum*: cloning, molecular analysis and search for a consensus motif," Microbiology, 142:1297-1309 (1996) |

TABLE 2-continued

GENES IDENTIFIED FROM GENBANK

| GenBank™ Accession No. | Gene Name | Gene Function | Reference |
|---|---|---|---|
| X90368 | | Promoter fragment PF109 | Patek, M. et al. "Promoters from *Corynebacterium glutamicum*: cloning, molecular analysis and search for a consensus motif," Microbiology, 142:1297-1309 (1996) |
| X93513 | amt | Ammonium transport system | Siewe, R. M. et al. "Functional and genetic characterization of the (methyl) ammonium uptake carrier of *Corynebacterium glutamicum*," J. Biol. Chem., 271(10):5398-5403 (1996) |
| X93514 | betP | Glycine betaine transport system | Peter, H. et al. "Isolation, characterization, and expression of the *Corynebacterium glutamicum* betP gene, encoding the transport system for the compatible solute glycine betaine," J. Bacteriol., 178(17):5229-5234 (1996) |
| X95649 | orf4 | | Patek, M. et al. "Identification and transcriptional analysis of the dapB-ORF2-dapA-ORF4 operon of *Corynebacterium glutamicum*, encoding two enzymes involved in L-lysine synthesis," Biotechnol. Lett., 19:1113-1117 (1997) |
| X96471 | lysE; lysG | Lysine exporter protein; Lysine export regulator protein | Vrljic, M. et al. "A new type of transporter with a new type of cellular function: L-lysine export from *Corynebacterium glutamicum*," Mol. Microbiol., 22(5):815-826 (1996) |
| X96580 | panB; panC; xylB | 3-methyl-2-oxobutanoate hydroxymethyltransferase; pantoate-beta-alanine ligase; xylulokinase | Sahm, H. et al. "D-pantothenate synthesis in *Corynebacterium glutamicum* and use of panBC and genes encoding L-valine systhesis for D-pantothenate overproduction," Appl. Environ. Microbiol., 65(5):1973-1979 (1999) |
| X96962 | | Insertion sequence IS1207 and transposase | |
| X99289 | | Elongation factor P | Ramos, A. et al. "Cloning, sequencing and expression of the gene encoding elongation factor P in the amino-acid producer *Brevibacterium lactofermentum* (*Corynebacterium glutamicum* ATCC 13689)," Gene, 198:217-222 (1997) |
| Y00140 | thrB | Homoserine kinase | Mateos, L. M. et al. "Nucleotide sequence of the homoserine kinase (thrB) gene of the *Brevibacterium lactofermentum*," Nucleic Acids Res., 15(9):3922 (1987) |
| Y00151 | ddh | Meso-diaminopimelate D-dehydrogenase (EC 1.4.1.16) | Ishino, S. et al. "Nucleotide sequence of the meso-diaminopimelate D-dehydrogenase gene from *Corynebacterium glutamicum*," Nucleic Acids Res., 15(9):3917 (1987) |
| Y00476 | thrA | Homoserine dehydrogenase | Mateos, L. M. et al. "Nucleotide sequence of the homoserine dehydrogenase (thrA) gene of the *Brevibacterium lactofermentum*," Nucleic Acids Res., 15(24); 10598 (1987) |
| Y00546 | hom; thrB | Homoserine dehydrogenase; homoserine kinase | Peoples, O. P. et al. "Nucleotide sequence and fine structural analysis of the *Corynebacterium glutamicum* hom-thrB operton," Mol. Microbiol., 2(1):63-72 (1988) |
| Y08964 | murC; ftsQ/divD; ftsZ | UPD-N-acetylmuramate-alanine ligase; division initiation protein or cell division protein; cell division protein | Honrubia, M. P. et al. "Identification, characterization, and chromosomal organization of the ftsZ gene from *Brevibacterium lactofermentum*," Mol. Gen. Genet., 259(1):97-104 (1998) |
| Y09163 | putP | High affinity proline transport system | Peter, H. et al. "Isolation of the putP gene of *Corynebacterium glutamicumproline* and characterization of a low-affinity uptake system for compatible solutes," Arch. Microbiol., 168 (2):143-151 (1997) |
| Y09548 | pyc | Pyruvate carboxylase | Peters-Wendisch, P. G. et al. "Pyruvate carboxylase from *Corynebacterium glutamicum*: characterization, expression and inactivation of the pyc gene," Microbiology, 144:915-927 (1998) |
| Y09578 | leuB | 3-isopropylmalate dehydrogenase | Patek, M. et al. "Analysis of the leuB gene from *Corynebacterium glutamicum*," Appl. Microbiol. Biotechnol., 50(1):42-47 (1998) |
| Y12472 | | Attachment site bacteriophage Phi-16 | Moreau, S. et al. "Site-specific integration of *corynephage* Phi-16: The construction of an integration vector," Microbiol., 145:539-548 (1999) |
| Y12537 | proP | Proline/ectoine uptake system protein | Peter, H. et al. "*Corynebacterium glutamicum* is equipped with four secondary carriers for compatible solutes: Identification, sequencing, and characterization of the proline/ectoine uptake system, ProP, and the ectoine/ proline/glycine betaine carrier, EctP," J. Bacteriol., 180(22):6005-6012 (1998) |
| Y13221 | glnA | Glutamine synthetase I | Jakoby, M. et al. "Isolation of *Corynebacterium glutamicum* glnA gene encoding glutamine synthetase I," FEMS Microbiol. Lett., 154(1):81-88 (1997) |
| Y16642 | lpd | Dihydrolipoamide dehydrogenase | |
| Y18059 | | Attachment site *Corynephage* 304L | Moreau, S. et al. "Analysis of the integration functions of φ304L: An integrase module among *corynephages*," Virology, 255(1):150-159 (1999) |

TABLE 2-continued

GENES IDENTIFIED FROM GENBANK

| GenBank ™ Accession No. | Gene Name | Gene Function | Reference |
|---|---|---|---|
| Z21501 | argS; lysA | Arginyl-tRNA synthetase; diaminopimelate decarboxylase (partial) | Oguiza, J. A. et al. "A gene encoding arginyl-tRNA synthetase is located in the upstream region of the lysA gene in *Brevibacterium lactofermentum*: Regulation of argS-lysA cluster expression by arginine," J. Bacteriol., 175(22):7356-7362 (1993) |
| Z21502 | dapA; dapB | Dihydrodipicolinate synthase; dihydrodipicolinate reductase | Pisabarro, A. et al. "A cluster of three genes (dapA, orf2, and dapB) of *Brevibacterium lactofermentum* encodes dihydrodipicolinate reductase, and a third polypeptide of unknown function," J. Bacteriol., 175(9):2743-2749 (1993) |
| Z29563 | thrC | Threonine synthase | Malumbres, M. et al. "Analysis and expression of the thrC gene of the encoded threonine synthase," Appl. Environ. Microbiol., 60(7)2209-2219 (1994) |
| Z46753 | 16S rDNA | Gene for 16S ribosomal RNA | |
| Z49822 | sigA | SigA sigma factor | Oguiza, J. A. et al. "Multiple sigma factor genes in *Brevibacterium lactofermentum*: Characterization of sigA and sigB," J. Bacteriol., 178(2):550-553 (1996) |
| Z49823 | galE; dtxR | Catalytic activity UDP-galactose 4-epimerase; diphtheria toxin regulatory protein | Oguiza, J. A. et al. "The galE gene encoding the UDP-galactose 4-epimerase of *Brevibacterium lactofermentum* is coupled transcriptionally to the dmdR gene," Gene, 177:103-107 (1996) |
| Z49824 | orf1; sigB | ?; SigB sigma factor | Oguiza, J. A. et al. "Multiple sigma factor genes in *Brevibacterium lactofermentum*: Characterization of sigA and sig B," J. Bacteriol., 178(2):550-553 (1996) |
| Z66534 | | Transposase | Correia, A. et al. "Cloning and characterization of an IS-like element present in the genome of *Brevibacterium lactofermentum* ATCC 13869," Gene, 170(1):91-94 (1996) |

[i] A sequence for this gene was published in the indicated reference. However, the sequence obtained by the inventors of the present application is significantly longer than the published version. It is believed that the published version relied on an incorrect start codon, and thus represents only a fragment of the actual coding region.

TABLE 3

*Corynebacterium* and *Brevibacterium* Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| *Brevibacterium* | *ammoniagenes* | 21054 | | | | | | | |
| *Brevibacterium* | *ammoniagenes* | 19350 | | | | | | | |
| *Brevibacterium* | *ammoniagenes* | 19351 | | | | | | | |
| *Brevibacterium* | *ammoniagenes* | 19352 | | | | | | | |
| *Brevibacterium* | *ammoniagenes* | 19353 | | | | | | | |
| *Brevibacterium* | *ammoniagenes* | 19354 | | | | | | | |
| *Brevibacterium* | *ammoniagenes* | 19355 | | | | | | | |
| *Brevibacterium* | *ammoniagenes* | 19356 | | | | | | | |
| *Brevibacterium* | *ammoniagenes* | 21055 | | | | | | | |
| *Brevibacterium* | *ammoniagenes* | 21077 | | | | | | | |
| *Brevibacterium* | *ammoniagenes* | 21553 | | | | | | | |
| *Brevibacterium* | *ammoniagenes* | 21580 | | | | | | | |
| *Brevibacterium* | *ammoniagenes* | 39101 | | | | | | | |
| *Brevibacterium* | *butanicum* | 21196 | | | | | | | |
| *Brevibacterium* | *divaricatum* | 21792 | P928 | | | | | | |
| *Brevibacterium* | *flavum* | 21474 | | | | | | | |
| *Brevibacterium* | *flavum* | 21129 | | | | | | | |
| *Brevibacterium* | *flavum* | 21518 | | | | | | | |
| *Brevibacterium* | *flavum* | | | B11474 | | | | | |
| *Brevibacterium* | *flavum* | | | B11472 | | | | | |
| *Brevibacterium* | *flavum* | 21127 | | | | | | | |
| *Brevibacterium* | *flavum* | 21128 | | | | | | | |
| *Brevibacterium* | *flavum* | 21427 | | | | | | | |
| *Brevibacterium* | *flavum* | 21475 | | | | | | | |
| *Brevibacterium* | *flavum* | 21517 | | | | | | | |
| *Brevibacterium* | *flavum* | 21528 | | | | | | | |
| *Brevibacterium* | *flavum* | 21529 | | | | | | | |
| *Brevibacterium* | *flavum* | | | B11477 | | | | | |
| *Brevibacterium* | *flavum* | | | B11478 | | | | | |
| *Brevibacterium* | *flavum* | 21127 | | | | | | | |

TABLE 3-continued

*Corynebacterium and Brevibacterium Strains Which May be Used in the Practice of the Invention*

| Genus | species | ATCC | FERM | NRRL | CECT | NCIMB | CBS | NCTC | DSMZ |
|---|---|---|---|---|---|---|---|---|---|
| *Brevibacterium* | *flavum* | | | B11474 | | | | | |
| *Brevibacterium* | *healii* | 15527 | | | | | | | |
| *Brevibacterium* | *ketoglutamicum* | 21004 | | | | | | | |
| *Brevibacterium* | *ketoglutamicum* | 21089 | | | | | | | |
| *Brevibacterium* | *ketosoreductum* | 21914 | | | | | | | |
| *Brevibacterium* | *lactofermentum* | | | | 70 | | | | |
| *Brevibacterium* | *lactofermentum* | | | | 74 | | | | |
| *Brevibacterium* | *lactofermentum* | | | | 77 | | | | |
| *Brevibacterium* | *lactofermentum* | 21798 | | | | | | | |
| *Brevibacterium* | *lactofermentum* | 21799 | | | | | | | |
| *Brevibacterium* | *lactofermentum* | 21800 | | | | | | | |
| *Brevibacterium* | *lactofermentum* | 21801 | | | | | | | |
| *Brevibacterium* | *lactofermentum* | | | B11470 | | | | | |
| *Brevibacterium* | *lactofermentum* | | | B11471 | | | | | |
| *Brevibacterium* | *lactofermentum* | 21086 | | | | | | | |
| *Brevibacterium* | *lactofermentum* | 21420 | | | | | | | |
| *Brevibacterium* | *lactofermentum* | 21086 | | | | | | | |
| *Brevibacterium* | *lactofermentum* | 31269 | | | | | | | |
| *Brevibacterium* | *linens* | 9174 | | | | | | | |
| *Brevibacterium* | *linens* | 19391 | | | | | | | |
| *Brevibacterium* | *linens* | 8377 | | | | | | | |
| *Brevibacterium* | *paraffinolyticum* | | | | | 11160 | | | |
| *Brevibacterium* | spec. | | | | | | 717.73 | | |
| *Brevibacterium* | spec. | | | | | | 717.73 | | |
| *Brevibacterium* | spec. | 14604 | | | | | | | |
| *Brevibacterium* | spec. | 21860 | | | | | | | |
| *Brevibacterium* | spec. | 21864 | | | | | | | |
| *Brevibacterium* | spec. | 21865 | | | | | | | |
| *Brevibacterium* | spec. | 21866 | | | | | | | |
| *Brevibacterium* | spec. | 19240 | | | | | | | |
| *Corynebacterium* | *acetoacidophilum* | 21476 | | | | | | | |
| *Corynebacterium* | *acetoacidophilum* | 13870 | | | | | | | |
| *Corynebacterium* | *acetoglutamicum* | | | B11473 | | | | | |
| *Corynebacterium* | *acetoglutamicum* | | | B11475 | | | | | |
| *Corynebacterium* | *acetoglutamicum* | 15806 | | | | | | | |
| *Corynebacterium* | *acetoglutamicum* | 21491 | | | | | | | |
| *Corynebacterium* | *acetoglutamicum* | 31270 | | | | | | | |
| *Corynebacterium* | *acetophilum* | | | B3671 | | | | | |
| *Corynebacterium* | *ammoniagenes* | 6872 | | | | | | 2399 | |
| *Corynebacterium* | *ammoniagenes* | 15511 | | | | | | | |
| *Corynebacterium* | *fujiokense* | 21496 | | | | | | | |
| *Corynebacterium* | *glutamicum* | 14067 | | | | | | | |
| *Corynebacterium* | *glutamicum* | 39137 | | | | | | | |
| *Corynebacterium* | *glutamicum* | 21254 | | | | | | | |
| *Corynebacterium* | *glutamicum* | 21255 | | | | | | | |
| *Corynebacterium* | *glutamicum* | 31830 | | | | | | | |
| *Corynebacterium* | *glutamicum* | 13032 | | | | | | | |
| *Corynebacterium* | *glutamicum* | 14305 | | | | | | | |
| *Corynebacterium* | *glutamicum* | 15455 | | | | | | | |
| *Corynebacterium* | *glutamicum* | 13058 | | | | | | | |
| *Corynebacterium* | *glutamicum* | 13059 | | | | | | | |
| *Corynebacterium* | *glutamicum* | 13060 | | | | | | | |
| *Corynebacterium* | *glutamicum* | 21492 | | | | | | | |
| *Corynebacterium* | *glutamicum* | 21513 | | | | | | | |
| *Corynebacterium* | *glutamicum* | 21526 | | | | | | | |
| *Corynebacterium* | *glutamicum* | 21543 | | | | | | | |
| *Corynebacterium* | *glutamicum* | 13287 | | | | | | | |
| *Corynebacterium* | *glutamicum* | 21851 | | | | | | | |
| *Corynebacterium* | *glutamicum* | 21253 | | | | | | | |
| *Corynebacterium* | *glutamicum* | 21514 | | | | | | | |
| *Corynebacterium* | *glutamicum* | 21516 | | | | | | | |
| *Corynebacterium* | *glutamicum* | 21299 | | | | | | | |
| *Corynebacterium* | *glutamicum* | 21300 | | | | | | | |
| *Corynebacterium* | *glutamicum* | 39684 | | | | | | | |
| *Corynebacterium* | *glutamicum* | 21488 | | | | | | | |
| *Corynebacterium* | *glutamicum* | 21649 | | | | | | | |
| *Corynebacterium* | *glutamicum* | 21650 | | | | | | | |
| *Corynebacterium* | *glutamicum* | 19223 | | | | | | | |
| *Corynebacterium* | *glutamicum* | 13869 | | | | | | | |
| *Corynebacterium* | *glutamicum* | 21157 | | | | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Corynebacterium | glutamicum | 21158 | | | | | | | |
| Corynebacterium | glutamicum | 21159 | | | | | | | |
| Corynebacterium | glutamicum | 21355 | | | | | | | |
| Corynebacterium | glutamicum | 31808 | | | | | | | |
| Corynebacterium | glutamicum | 21674 | | | | | | | |
| Corynebacterium | glutamicum | 21562 | | | | | | | |
| Corynebacterium | glutamicum | 21563 | | | | | | | |
| Corynebacterium | glutamicum | 21564 | | | | | | | |
| Corynebacterium | glutamicum | 21565 | | | | | | | |
| Corynebacterium | glutamicum | 21566 | | | | | | | |
| Corynebacterium | glutamicum | 21567 | | | | | | | |
| Corynebacterium | glutamicum | 21568 | | | | | | | |
| Corynebacterium | glutamicum | 21569 | | | | | | | |
| Corynebacterium | glutamicum | 21570 | | | | | | | |
| Corynebacterium | glutamicum | 21571 | | | | | | | |
| Corynebacterium | glutamicum | 21572 | | | | | | | |
| Corynebacterium | glutamicum | 21573 | | | | | | | |
| Corynebacterium | glutamicum | 21579 | | | | | | | |
| Corynebacterium | glutamicum | 19049 | | | | | | | |
| Corynebacterium | glutamicum | 19050 | | | | | | | |
| Corynebacterium | glutamicum | 19051 | | | | | | | |
| Corynebacterium | glutamicum | 19052 | | | | | | | |
| Corynebacterium | glutamicum | 19053 | | | | | | | |
| Corynebacterium | glutamicum | 19054 | | | | | | | |
| Corynebacterium | glutamicum | 19055 | | | | | | | |
| Corynebacterium | glutamicum | 19056 | | | | | | | |
| Corynebacterium | glutamicum | 19057 | | | | | | | |
| Corynebacterium | glutamicum | 19058 | | | | | | | |
| Corynebacterium | glutamicum | 19059 | | | | | | | |
| Corynebacterium | glutamicum | 19060 | | | | | | | |
| Corynebacterium | glutamicum | 19185 | | | | | | | |
| Corynebacterium | glutamicum | 13286 | | | | | | | |
| Corynebacterium | glutamicum | 21515 | | | | | | | |
| Corynebacterium | glutamicum | 21527 | | | | | | | |
| Corynebacterium | glutamicum | 21544 | | | | | | | |
| Corynebacterium | glutamicum | 21492 | | | | | | | |
| Corynebacterium | glutamicum | | | B8183 | | | | | |
| Corynebacterium | glutamicum | | | B8182 | | | | | |
| Corynebacterium | glutamicum | | | B12416 | | | | | |
| Corynebacterium | glutamicum | | | B12417 | | | | | |
| Corynebacterium | glutamicum | | | B12418 | | | | | |
| Corynebacterium | glutamicum | | | B11476 | | | | | |
| Corynebacterium | glutamicum | 21608 | | | | | | | |
| Corynebacterium | lilium | | P973 | | | | | | |
| Corynebacterium | nitrilophilus | 21419 | | | | 11594 | | | |
| Corynebacterium | spec. | | P4445 | | | | | | |
| Corynebacterium | spec. | | P4446 | | | | | | |
| Corynebacterium | spec. | 31088 | | | | | | | |
| Corynebacterium | spec. | 31089 | | | | | | | |
| Corynebacterium | spec. | 31090 | | | | | | | |
| Corynebacterium | spec. | 31090 | | | | | | | |
| Corynebacterium | spec. | 31090 | | | | | | | |
| Corynebacterium | spec. | 15954 | | | | | | | 20145 |
| Corynebacterium | spec. | 21857 | | | | | | | |
| Corynebacterium | spec. | 21862 | | | | | | | |
| Corynebacterium | spec. | 21863 | | | | | | | |

ATCC: American Type Culture Collection, Rockville, MD, USA
FERM: Fermentation Research Institute, Chiba, Japan
NRRL: ARS Culture Collection, Northern Regional Research Laboratory, Peoria, IL, USA
CECT: Coleccion Espanola de Cultivos Tipo, Valencia, Spain
NCIMB: National Collection of Industrial and Marine Bacteria Ltd., Aberdeen, UK
CBS: Centraalbureau voor Schimmelcultures, Baarn, NL
NCTC: National Collection of Type Cultures, London, UK
DSMZ: Deutsche Sammlung von Mikroorganismen und Zellkulturen, Braunschweig, Germany
For reference see Sugawara, H. et al. (1993) World directory of collections of cultures of microorganisms: Bacteria, fungi and yeasts (4th edn), World federation for culture collections world data center on microorganisms, Saimata, Japen.

TABLE 4

ALIGNMENT RESULTS

| ID # | length (NT) | Genbank Hit | Length Accession | Name of Genbank Hit | Source of Genbank Hit | % homology (GAP) | Date of Deposit |
|---|---|---|---|---|---|---|---|
| rxa00013 | 996 | GB_GSS4:AQ713475 | 581 AQ713475 | HS_5402_B2_A12_T7A RPCI-11 Human Male BAC Library Homo sapiens genomic clone Plate = 978 Col = 24 Row = B, genomic survey sequence. | Homo sapiens | 37,148 | Jul. 13, 1999 |
| | | GB_HTG3:AC007420 | 130583 AC007420 | Drosophila melanogaster chromosome 2 clone BACR07M10 (D630) RPCI-98 07.M.10 map 24A-24D strain y; cn bw sp, *** SEQUENCING IN PROGRESS ***, 83 unordered pieces. | Drosophila melanogaster | 34,568 | Sep. 20, 1999 |
| | | GB_HTG3:AC007420 | 130583 AC007420 | Drosophila melanogaster chromosome 2 clone BACR07M10 (D630) RPCI-98 07.M.10 map 24A-24D strain y; cn bw sp, *** SEQUENCING IN PROGRESS ***, 83 unordered pieces. | Drosophila melanogaster | 34,568 | Sep. 20, 1999 |
| rxa00014 | 903 | GB_BA1:MTCY3A2 | 25830 Z83867 | Mycobacterium tuberculosis H37Rv complete genome; segment 136/162. | Mycobacterium tuberculosis | 58,140 | Jun. 17, 1998 |
| | | GB_BA1:MLCB1779 | 43254 Z98271 | Mycobacterium leprae cosmid B1779. | Mycobacterium leprae | 57,589 | Aug. 8, 1997 |
| | | GB_BA1:SAPURCLUS | 9120 X92429 | S. albonigaer napH, pur7, pur10, pur6, pur4, pur5 and pur3 genes. | Streptomyces anulatus | 55,667 | Feb. 28, 1996 |
| rxa00030 | 513 | GB_EST21:C89713 | 767 C89713 | C89713 Dictyostelium discoideum SS (H. Urushihara) Dictyostelium discoideum cDNA clone SSG229, mRNA sequence. | Dictyostelium discoideum | 45,283 | Apr. 20, 1998 |
| | | GB_EST28:AI497294 | 484 AI497294 | fb63g03.y1 Zebrafish WashU MPIMG EST Danio rerio cDNA 5' similar to SW:AFP4_MYOOC P80961 ANTIFREEZE PROTEIN LS-12. ;. mRNA sequence. | Danio rerio | 42,991 | Mar. 11, 1999 |
| | | GB_EST21:C92167 | 637 C92167 | C92167 Dictyostelium discoideum SS (H. Urushihara) Dictyostelium discoideum cDNA clone SSD179, mRNA sequence. | Dictyostelium discoideum | 44,444 | Jul. 12, 1999 |
| rxa00032 | 1632 | GB_BA2:AF010496 | 189370 AF010496 | Rhodobacter capsulatus strain SB1003, partial genome. | Rhodobacter capsulatus | 39,689 | May 12, 1998 |
| | | GB_BA2:AF018073 | 9810 AF018073 | Rhodobacter sphaeroides operon sorbitol (smoC), periplasmic sorbitol-binding protein (smoF), sorbitol/mannitol transport inner membrane protein (smoG), sorbitol/mannitol transport inner membrane protein (smoG), sorbitol/mannitol transport ATP-binding transport protein (smoK), sorbitol dehydrogenase (smoS), mannitol dehydrogenase (mtlK), and periplasmic mannitol-binding protein (smoM) genes, complete cds. | Rhodobacter sphaeroides | 48,045 | Oct. 22, 1997 |
| rxa00041 | | GB_BA2:AF045245 | 5930 AF045245 | Klebsiella pneumoniae D-arabinitol transporter (dalT), D-arabinitol kinase (dalK), D-arabinitol dehydrogenase (dalD), and repressor (dalR) genes, complete cds. | Klebsiella pneumoniae | 38,514 | Jul. 16, 1998 |
| | 1342 | EM_PAT:E11760 | 6911 E11760 | Base sequence of sucrase gene. | Corynebacterium glutamicum | 99,031 | Oct. 8, 1997 (Rel. 52, Created) |
| rxa00042 | | GB_PAT:I26124 | 6911 I26124 | Sequence 4 from U.S. Pat. No. 5556776. | Unknown. | 99,031 | Oct. 7, 1996 |
| | | GB_IN1:LMFL5883 | 31934 AL117384 | Leishmania major Friedlin chromosome 23 cosmid L5883, complete sequence. | Leishmania major | 43,663 | Oct. 21, 1999 |
| | 882 | EM_PAT:E11760 | 6911 E11760 | Base sequence of sucrase gene. | Corynebacterium glutamicum | 94,767 | Oct. 8, 1997 (Rel. 52, Created) |
| rxa00043 | | GB_PAT:I26124 | 6911 I26124 | Sequence 4 from U.S. Pat. No. 5556776. | Unknown. | 94,767 | Oct. 7, 1996 |
| | | GB_IN1:CEU33051 | 4899 U33051 | Caenorhabditis elegans sur-2 mRNA, complete cds. | Caenorhabditis elegans | 40,276 | Jan. 23, 1996 |
| | 1287 | GB_PAT:I26124 | 6911 I26124 | Sequence 4 from U.S. Pat. No. 5556776. | Unknown. | 97,591 | Oct. 7, 1996 |
| | | EM_PAT:E11760 | 6911 E11760 | Base sequence of sucrase gene. | Corynebacterium glutamicum | 97,591 | Oct. 8, 1997 (Rel. 52, Created) |
| rxa00098 | | GB_PR3:AC005174 | 39769 AC005174 | Homo sapiens clone UWGC:g1564a012 from 7p14-15, complete sequence. | Homo sapiens | 35,879 | Jun. 24, 1998 |
| | | GB_BA1:MSU88433 | 1928 U88433 | Mycobacterium smegmatis phosphoglucose isomerase gene, complete cds. | Mycobacterium smegmatis | 62,658 | Apr. 19, 1997 |
| | | GB_BA1:SC5A7 | 40037 AL031107 | Streptomyces coelicolor cosmid 5A7. | Streptomyces coelicolor | 37,638 | Jul. 27, 1998 |
| | 1743 | GB_BA1:MTCY10D7 | 39800 Z79700 | Mycobacterium tuberculosis H37Rv complete genome; segment 44/162. | Mycobacterium tuberculosis | 36,784 | Jun. 17, 1998 |

TABLE 4-continued

ALIGNMENT RESULTS

| ID # | length (NT) | Genbank Hit | Length Accession | Name of Genbank Hit | Source of Genbank Hit | % homology (GAP) | Date of Deposit |
|---|---|---|---|---|---|---|---|
| rxa00148 | 2334 | GB_BA1:MTCY277 | 38300 Z79701 | Mycobacterium tuberculosis H37Rv complete genome; segment 65/162. | Mycobacterium tuberculosis | 67.547 | Jun. 17, 1998 |
|  |  | GB_BA1:MSGY456 | 37316 AD000001 | Mycobacterium tuberculosis sequence from clone y456. | Mycobacterium tuberculosis | 40.883 | Dec. 3, 1996 |
|  |  | GB_BA1:MSGY175 | 18106 AD000015 | Mycobacterium tuberculosis sequence from clone y175. | Mycobacterium tuberculosis | 67.457 | Dec. 10, 1996 |
| rxa00149 | 1971 | GB_BA1:MSGY456 | 37316 AD000001 | Mycobacterium tuberculosis sequence from clone y456. | Mycobacterium tuberculosis | 35.883 | Dec. 3, 1996 |
|  |  | GB_BA1:MSGY175 | 18106 AD000015 | Mycobacterium tuberculosis sequence from clone y175. | Mycobacterium tuberculosis | 51.001 | Dec. 10, 1996 |
|  |  | GB_BA1:MTCY277 | 38300 Z79701 | Mycobacterium tuberculosis H37Rv complete genome; segment 65/162. | Mycobacterium tuberculosis | 51.001 | Jun. 17, 1998 |
| rxa00195 | 684 | GB_BA1:MTCY274 | 39991 Z74024 | Mycobacterium tuberculosis H37Rv complete genome; segment 126/162. | Mycobacterium tuberculosis | 35.735 | Jun. 19, 1998 |
|  |  | GB_BA1:MSGB1529CS | 36985 L78824 | Mycobacterium leprae cosmid B1529 DNA sequence. | Mycobacterium leprae | 57.014 | Jun. 15, 1996 |
|  |  | GB_BA1:MTCY274 | 39991 Z74024 | Mycobacterium tuberculosis H37Rv complete genome; segment 126/162. | Mycobacterium tuberculosis | 41.892 | Jun. 19, 1998 |
| rxa00196 | 738 | GB_BA1:MTCY274 | 39991 Z74024 | Mycobacterium tuberculosis H37Rv complete genome; segment 126/162. | Mycobacterium tuberculosis | 41.841 | Jun. 19, 1998 |
|  |  | GB_BA1:MTCY274 | 39991 Z74024 | Mycobacterium tuberculosis H37Rv complete genome; segment 126/162. | Mycobacterium tuberculosis | 36.599 | Jun. 19, 1998 |
|  |  | GB_RO:RATCBRQ | 10752 M55532 | Rat carbohydrate binding receptor gene, complete cds. | Rattus norvegicus | 36.212 | Apr. 27, 1993 |
| rxa00202 | 1065 | GB_EST11:AA253618 | 313 AA253618 | mw95c10.r1 Soares mouse NML Mus musculus cDNA clone IMAGE:678450 5', mRNA sequence. | Mus musculus | 38.816 | Mar. 13, 1997 |
|  |  | GB_EST26:AI390284 | 490 AI390284 | mw96a03.y1 Soares mouse NML Mus musculus cDNA clone IMAGE:678508 5' similar to TR:O09171 O09171 BETAINE-HOMOCYSTEINE METHYLTRANSFERASE;, mRNA sequence. | Mus musculus | 42.239 | Feb. 2, 1999 |
|  |  | GB_EST26:AI390280 | 467 AI390280 | mw95c10.y1 Soares mouse NML Mus musculus cDNA clone IMAGE:678450 5', mRNA sequence. | Mus musculus | 37.307 | Feb. 2, 1999 |
| rxa00206 | 1161 | GB_BA1:MLCB637 | 44882 Z99263 | Mycobacterium leprae cosmid B637. | Mycobacterium leprae | 58.312 | Sep. 17, 1997 |
|  |  | GB_BA1:MTV012 | 70287 AL021287 | Mycobacterium tuberculosis H37Rv complete genome; segment 132/162. | Mycobacterium tuberculosis | 36.632 | Jun. 23, 1999 |
|  |  | GB_BA1:SC6E10 | 23990 AL109661 | Streptomyces coelicolor cosmid 6E10. | Streptomyces coelicolor A3(2) | 38.616 | Aug. 5, 1999 |
| rxa00224 | 1074 | GB_BA1:BJU32230 | 1769 U32230 | Bradyrhizobium japonicum electron transfer flavoprotein small subunit (etfS) nd large subunit (etfL) genes, complete cds. | Bradyrhizobium japonicum | 48.038 | May 25, 1996 |
|  |  | GB_BA1:PDEETFAB | 2440 L14864 | Paracoccus denitrificans electron transfer flavoprotein alpha and beta subunit genes, complete cds's. | Paracoccus denitrificans | 48.351 | Oct. 27, 1993 |
|  |  | GB_HTG3:AC009689 | 177954 AC009689 | Homo sapiens chromosome 4 clone 104_F_7 map 4, LOW-PASS SEQUENCE SAMPLING. | Homo sapiens | 38.756 | Aug. 28, 1999 |
| rxa00225 | 909 | GB_RO:AF060178 | 2057 AF060178 | Mus musculus heparan sulfate 2-sulfotransferase (Hs2st) mRNA, complete cds. | Mus musculus | 39.506 | Jun. 18, 1998 |
|  |  | GB_GSS11:AQ325043 | 734 AQ325043 | mgxb0020lO1r CUGI Rice Blast BAC Library Magnaporthe grisea genomic clone mgxb0020lO1r, genomic survey sequence. | Magnaporthe grisea | 38.333 | Jan. 8, 1999 |
| rxa00235 | 1398 | GB_EST31:AI676413 | 551 AI676413 | etmEST0167 EtH1 Eimeria tenella cDNA clone etmc074 5', mRNA sequence. | Eimeria tenella | 35.542 | May 19, 1999 |
|  |  | GB_BA1:MTCY10G2 | 38970 Z92539 | Mycobacterium tuberculosis H37Rv complete genome; segment 47/162. | Mycobacterium tuberculosis | 65.759 | Jun. 17, 1998 |
|  |  | GB_BA2:AF061753 | 3721 AF061753 | Nitrosomonas europaea CTP synthase (pyrG) gene, partial cds; and enolase (eno) gene, complete cds. | Nitrosomonas europaea | 58.941 | Aug. 31, 1998 |
|  |  | GB_BA2:AF086791 | 37867 AF086791 | Zymomonas mobilis strain ZM4 clone 67E10 carbamoylphosphate synthetase small subunit (carA), carbamoylphosphate synthetase large subunit (carB), transcription elongation factor (greA), enolase (eno), pyruvate dehydrogenase alpha subunit (pdhA), pyruvate dehydrogenase beta subunit (pdhB), ribonuclease H (rnh), homoserine kinase homolog, alcohol dehydrogenase II (adhB), and excinuclease ABC subunit A (uvrA) genes, complete cds; and unknown genes. | Zymomonas mobilis | 61.239 | Nov. 4, 1998 |
| rxa00246 | 1158 | GB_BA2:AF012550 | 2690 AF012550 | Acinetobacter sp. BD413 ComP (comP) gene, complete cds. | Acinetobacter sp. BD413 | 53.726 | Sep. 27, 1999 |
|  |  | GB_PAT:E03856 | 1506 E03856 | gDNA encoding alcohol dehydrogenase. | Bacillus stearothermophilus | 51.688 | Sep. 29, 1997 |
|  |  | GB_BA1:BACADHT | 1668 D90421 | B. stearothermophilus adhT gene for alcohol dehydrogenase. | Bacillus stearothermophilus | 51.602 | Feb. 7, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00251 | 831 | GB_BA1:MTCY20G9 | 37218 | Z77162 | *Mycobacterium tuberculosis* H37Rv complete genome; segment 25/162. | *Mycobacterium tuberculosis* | 42,875 | Jun. 17, 1998 |
| | | GB_BA1:MTV004 | 69350 | AL009198 | *Mycobacterium tuberculosis* H37Rv complete genome; segment 144/162. | *Mycobacterium tuberculosis* | 40,380 | Jun. 18. 1998 |
| | | GB_BA1:MTV004 | 69350 | AL009198 | *Mycobacterium tuberculosis* H37Rv complete genome; segment 144/162. | *Mycobacterium tuberculosis* | 41,789 | Jun. 18, 1998 |
| rxa00288 | 1134 | GB_BA2:AF050114 | 1038 | AF050114 | *Pseudomonas* sp. W7 alginate lyase gene, complete cds. | *Pseudomonas* sp. W7 | 49,898 | Mar. 3, 1999 |
| | | GB_GSS3:B16984 | 469 | B16984 | 344A14.TVC CIT978SKA1 *Homo sapiens* genomic clone A-344A14, genomic survey sequence. | *Homo sapiens* | 39,355 | Jun. 4, 1998 |
| | | GB_IN2:AF144549 | 7887 | AF144549 | *Aedes albopictus* ribosomal protein L34 (rpl34) gene, complete cds. | *Aedes albopictus* | 36,509 | Jun. 3, 1999 |
| rxa00293 | 1035 | GB_EST1:T28483 | 313 | T28483 | EST46182 Human Kidney *Homo sapiens* cDNA 3' end similar to flavin-containing monooxygenase 1 (HT:1956), mRNA sequence. | *Homo sapiens* | 42,997 | Sep. 6, 1995 |
| | | GB_PR1:HUMFMO1 | 2134 | M64082 | Human flavin-containing monooxygenase (FMO1) mRNA, complete cds. | *Homo sapiens* | 37,915 | Nov. 8, 1994 |
| | | GB_EST32:AI734238 | 512 | AI734238 | zb73c05.y5 Soares_fetal_lung NbHL19W *Homo sapiens* cDNA clone IMAGE:309224 5' similar to gb:M64082 DIMETHYLANILINE MONOOXYGENASE (HUMAN);, mRNA sequence. | *Homo sapiens* | 41,502 | Jun. 14, 1999 |
| rxa00296 | 2967 | GB_HTG6:AC011069 | 168266 | AC011069 | *Drosophila melanogaster* chromosome X clone BACR11H20 (D881) RPCI-98 11.H.20 map 12B-12C strain y; cn bw sp, *** SEQUENCING IN PROGRESS ***, 92 unordered pieces. | *Drosophila melanogaster* | 33,890 | Dec. 2, 1999 |
| | | GB_EST15:AA531468 | 414 | AA531468 | nj63d12.s1 NCI_CGAP_Pr10 *Homo sapiens* cDNA clone IMAGE:997175, mRNA sequence. | *Homo sapiens* | 40,821 | Aug. 20, 1997 |
| | | GB_HTG6:AC011069 | 168266 | AC011069 | *Drosophila melanogaster* chromosome X clone BACR11H20 (D881) RPCI-98 11.H.20 map 12B-12C strain y; cn bw sp, *** SEQUENCING IN PROGRESS ***, 92 unordered pieces. | *Drosophila melanogaster* | 30,963 | Dec. 2, 1999 |
| rxa00310 | 558 | GB_VI:VMVY16780 | 186986 | Y16780 | variola minor virus complete genome. | variola minor virus | 35,883 | Sep. 2, 1999 |
| | | GB_VI:VARCG | 186103 | L22579 | Variola major virus (strain Bangladesh-1975) complete genome. | Variola major virus | 34,664 | Jan. 12, 1995 |
| | | GB_VI:VVCGAA | 185578 | X69198 | Variola virus DNA complete genome. | Variola virus | 36,000 | Dec. 13, 1996 |
| rxa00317 | 777 | GB_HTG3:AC009571 | 159648 | AC009571 | *Homo sapiens* chromosome 4 clone 57_A_22 map 4, *** SEQUENCING IN PROGRESS ***, 8 unordered pieces. | *Homo sapiens* | 36,988 | Sep. 29, 1999 |
| | | GB_HTG3:AC009571 | 159648 | AC009571 | *Homo sapiens* chromosome 4 clone 57_A_22 map 4, *** SEQUENCING IN PROGRESS ***, 8 unordered pieces. | *Homo sapiens* | 36,988 | Sep. 29, 1999 |
| | | GB_PR3:AC005697 | 174503 | AC005697 | *Homo sapiens* chromosome 17, clone hRPK.138_P_22, complete sequence | *Homo sapiens* | 36,340 | Oct. 9, 1998 |
| rxa00327 | 507 | GB_BA1:LCATPASEB | 1514 | X64542 | *L. casei* gene for ATPase beta-subunit. | *Lactobacillus casaei* | 34,664 | Dec. 11, 1992 |
| | | GB_BA1:LCATPASEB | 1514 | X64542 | *L. casei* gene for ATPase beta-subunit. | *Lactobacillus casei* | 39,308 | Dec. 11, 1992 |
| rxa00328 | 615 | GB_BA1:STYPUTPE | 1887 | L01138 | *Salmonella* (S2980) proline permease (putP) gene, 5' end. | *Salmonella* sp. | 39,623 | May 9, 1996 |
| | | GB_BA1:STYPUTPF | 1887 | L01139 | *Salmonella* (S2983) proline permease (putP) gene, 5' end. | *Salmonella* sp. | 39,623 | May 9, 1996 |
| | | GB_BA1:STYPUTPI | 1889 | L01142 | *Salmonella* (S3015) proline permease (putP) gene, 5' end. | *Salmonella* sp. | 42,906 | May 9, 1996 |
| rxa00329 | 1347 | GB_PR3:AC004691 | 141990 | AC004691 | *Homo sapiens* PAC clone DJ0740D02 from 7p14-p15, complete sequence. | *Homo sapiens* | 38,142 | May 16, 1998 |
| | | GB_PR4:AC004916 | 129014 | AC004916 | *Homo sapiens* clone DJ0891L14, complete sequence. | *Homo sapiens* | 38,549 | Jul. 17, 1999 |
| | | GB_PR3:AC004691 | 141990 | AC004691 | *Homo sapiens* PAC clone DJ0740002 from 7p14-p15, complete sequence. | *Homo sapiens* | 35,865 | May 16, 1998 |
| rxa00340 | 1269 | GB_BA1:MTCY427 | 38110 | Z70692 | *Mycobacterium tuberculosis* H37Rv complete genome; segment 99/162. | *Mycobacterium tuberculosis* | 38,940 | Jun. 24, 1999 |
| | | GB_GSS12:AQ412290 | 238 | AQ412290 | RPCI-11-195H2.TV RPCI-11 *Homo sapiens* genomic clone RPCI-11-195H2, genomic survey sequence. | *Homo sapiens* | 36,555 | Mar. 23, 1999 |
| | | GB_PL2:AF112871 | 2394 | AF112871 | *Astasia longa* small subunit ribosomal RNA gene, complete sequence. | *Astasia longa* | 36,465 | Jun. 28, 1999 |
| rxa00379 | 307 | GB_HTG1:CEY56A3 | 224746 | AL022280 | *Caenorhabditis elegans* chromosome III clone Y56A3, *** SEQUENCING IN PROGRESS ***, in unordered pieces. | *Caenorhabditis elegans* | 35,179 | Sep. 6, 1999 |
| | | GB_HTG1:CEY56A3 | 224746 | AL022280 | *Caenorhabditis elegans* chromosome III clone Y56A3, *** SEQUENCING IN PROGRESS ***, in unordered pieces. | *Caenorhabditis elegans* | 35,179 | Sep. 6, 1999 |
| | | GB_PR2:HS134O19 | 86897 | AL034555 | Human DNA sequence from clone 134O19 on chromosome 1p36.11-36.33, complete sequence. | *Homo sapiens* | 40,604 | Nov. 23, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00381 | 729 | GB_GSS4:AQ730532 | 416 | AQ730532 | HS_2149_A1_C06_T7C CIT Approved Human Genomic Sperm Library D Homo sapiens genomic clone Plate = 2149 Col = 11 Row = E, genomic survey sequence. | Homo sapiens | 35,766 | Jul. 15, 1999 |
| | | GB_EST23:AI120939 | 561 | AI120939 | ub74f05.r1 Soares mouse mammary gland NMLMG Mus musculus cDNA clone IMAGE:1383489 5' similar to gb:J04046 CALMODULIN (HUMAN); gb:M19381 Mouse calmodulin (MOUSE); mRNA sequence. | Mus musculus | 41,113 | Sep. 2, 1998 |
| | | GB_EST23:AI120939 | 561 | AI120939 | ub74f05.r1 Soares mouse mammary gland NMLMG Mus musculus cDNA clone IMAGE:1383489 5' similar to gb:J04046 CALMODULIN (HUMAN); gb:M19381 Mouse calmodulin (MOUSE); mRNA sequence. | Mus musculus | 41,113 | Sep. 2, 1998 |
| rxa00385 | 362 | GB_EST32:AI726450 | 565 | AI726450 | BNLGHi5857 Six-day Cotton fiber Gossypium hirsutum cDNA 5' similar to (AF015913) Skb1Hs [Homo sapiens], mRNA sequence. | Gossypium hirsutum | 41,152 | Jun. 11, 1999 |
| | | GB_GSS4:AQ740856 | 768 | AQ740856 | HS_2274_A2_A07_T7C CIT Approved Human Genomic Sperm Library D Homo sapiens genomic clone Plate = 2274 Col = 14 Row = A, genomic survey sequence. | Homo sapiens | 41,360 | Jul. 16, 1999 |
| rxa00388 | 1134 | GB_PR1:HSPAIP | 1587 | X91809 | H. sapiens mRNA for GAIP protein. | Homo sapiens | 36,792 | Mar. 29, 1996 |
| | | GB_BA1:MTY25D10 | 40838 | Z95558 | Mycobacterium tuberculosis H37Rv complete genome; segment 28/162. | Mycobacterium tuberculosis | 51,852 | Jun. 17, 1998 |
| | | GB_BA1:MSGY224 | 40051 | AD000004 | Mycobacterium tuberculosis sequence from clone y224. | Mycobacterium tuberculosis | 51,852 | Dec. 3, 1996 |
| | | GB_HTG1:AP000471 | 72466 | AP000471 | Homo sapiens chromosome 21 clone B2308H15 map 21q22.3, *** SEQUENCING IN PROGRESS ***, in unordered pieces. | Homo sapiens | 36,875 | Sep. 13, 1999 |
| rxa00427 | 909 | GB_BA1:MSGY126 | 37164 | AD000012 | Mycobacterium tuberculosis sequence from clone y126. | Mycobacterium tuberculosis | 60,022 | Dec. 10, 1996 |
| | | GB_BA1:MTY13D12 | 37085 | Z80343 | Mycobacterium tuberculosis H37Rv complete genome; segment 156/162. | Mycobacterium tuberculosis | 60,022 | Jun. 17, 1998 |
| | | GB_HTG1:CEY48C3 | 270193 | Z92855 | Caenorhabditis elegans chromosome II clone Y48C3, *** SEQUENCING IN PROGRESS ***, in unordered pieces. | Caenorhabditis elegans | 28,013 | May 29, 1999 |
| rxa00483 | 1587 | GB_PR2:HSAF001550 | 173882 | AF001550 | Homo sapiens chromosome 16 BAC clone CIT9875K-334D11 complete sequence. | Homo sapiens | 38,226 | Aug. 22, 1997 |
| | | GB_BA1:LLCPJW565 | 12828 | Y12736 | Lactococcus lactis cremoris plasmid pJW565 DNA, abiM, abiiR genes and orfX. | Lactococcus lactis subsp. cremoris | 37,942 | Mar. 1, 1999 |
| | | GB_HTG2:AC006754 | 206217 | AC006754 | Caenorhabditis elegans clone Y40B10, *** SEQUENCING IN PROGRESS ***, 5 unordered pieces. | Caenorhabditis elegans | 36,648 | Feb. 23, 1999 |
| rxa00511 | 615 | GB_PR3:HSE127C11 | 38423 | Z74581 | Human DNA sequence from cosmid E127C11 on chromosome 22q11.2-qter contains STS. | Homo sapiens | 39,831 | Nov. 23, 1999 |
| | | GB_PR3:HSE127C11 | 38423 | Z74581 | Human DNA sequence from cosmid E127C11 on chromosome 22q11.2-qter contains STS. | Homo sapiens | 36,409 | Nov. 23, 1999 |
| rxa00512 | 718 | GB_BA1:MTCY22G8 | 22550 | Z95585 | Mycobacterium tuberculosis H37Rv complete genome; segment 49/162. | Mycobacterium tuberculosis | 56,232 | Jun. 17, 1998 |
| | | GB_BA1:MSGLTA | 1776 | X60513 | M. smegmatis gltA gene for citrate synthase. | Mycobacterium smegmatis | 56,143 | Sep. 20, 1991 |
| | | GB_BA2:ECU73857 | 128824 | U73857 | Escherichia coli chromosome minutes 6-8. | Escherichia coli | 48,563 | Jul. 14, 1999 |
| rxa00517 | 1164 | GB_HTG2:AC006911 | 298804 | AC006911 | Caenorhabditis elegans clone Y94H6x, *** SEQUENCING IN PROGRESS ***, 15 unordered pieces. | Caenorhabditis elegans | 37,889 | Feb. 24, 1999 |
| | | GB_HTG2:AC006911 | 298804 | AC006911 | Caenorhabditis elegans clone Y94H6x, *** SEQUENCING IN PROGRESS ***, 15 unordered pieces. | Caenorhabditis elegans | 37,889 | Feb. 24, 1999 |
| | | GB_EST29:AI602158 | 481 | AI602158 | UI-R-AB0-vy-a-01-0-UI.s2 UI-R-AB0 Rattus norvegicus cDNA clone UI-R-AB0-vy-a-01-0-UI 3', mRNA sequence. | Rattus norvegicus | 40,833 | Apr. 21, 1999 |
| rxa00518 | 320 | GB_BA2:ECU73857 | 128824 | U73857 | Escherichia coli chromosome minutes 6-8. | Escherichia coli | 49,668 | Jul. 14, 1999 |
| | | GB_BA2:STU51879 | 8371 | U51879 | Salmonella typhimurium propionate catabolism operon: RpoN activator protein homolog (prpR), carboxyphosphoenolpyruvate phosphonomutase homolog (prpB), citrate synthase homolog (prpC), prpD and prpE genes, complete cds. | Salmonella typhimurium | 50,313 | Aug. 5, 1999 |
| | | GB_BA2:AE000140 | 12498 | AE000140 | Escherichia coli K-12 MG1655 section 30 of 400 of the complete genome. | Escherichia coli | 49,688 | Nov. 12, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00606 | 2378 | GB_EST32:AU068253 | 376 | AU068253 | AU068253 Rice callus *Oryza sativa* cDNA clone C12658_9A, mRNA sequence. | *Oryza sativa* | 41,333 | Jun. 7, 1999 |
| | | GB_EST13:AA363046 | 329 | AA363046 | EST72922 Ovary II *Homo sapiens* cDNA 5′ end, mRNA sequence. | *Homo sapiens* | 34,347 | Apr. 21, 1997 |
| | | GB_EST32:AU068253 | 376 | AU068253 | AU068253 Rice callus *Oryza sativa* cDNA clone C12658_9A, mRNA sequence. | *Oryza sativa* | 41,899 | Jun. 7, 1999 |
| rxa00635 | 1860 | GB_BA1:PAORF1 | 1440 | X13378 | *Pseudomonas amyloderamosa* DNA for ORF 1. | *Pseudomonas amyloderamosa* | 53,912 | Jul. 14, 1995 |
| | | GB_BA1:PAORF1 | 1440 | X13378 | *Pseudomonas amyloderamosa* DNA for ORF 1. | *Pseudomonas amyloderamosa* | 54,422 | Jul. 14, 1995 |
| rxa00679 | 1389 | GB_PL2:AC010871 | 80381 | AC010871 | *Arabidopsis thaliana* chromosome III BAC T16O11 genomic sequence, complete sequence. | *Arabidopsis thaliana* | 38,244 | Nov. 13, 1999 |
| | | GB_PL1:AT81KBGEN | 81493 | X98130 | *A. thaliana* 81 kb genomic sequence. | *Arabidopsis thaliana* | 36,091 | Mar. 12, 1997 |
| | | GB_PL2:AC010871 | 80381 | AC010871 | *Arabidopsis thaliana* chromosome III BAC T16O11 genomic sequence, complete sequence. | *Arabidopsis thaliana* | 37,135 | Nov. 13, 1999 |
| rxa00680 | 441 | GB_PR3:AC004058 | 38400 | AC004058 | *Homo sapiens* chromosome 4 clone B241P19 map 4q25, complete sequence | *Homo sapiens* | 36,165 | Sep. 30, 1998 |
| | | GB_PL1:AT81KBGEN | 81493 | X98130 | *A. thaliana* 81 kb genomic sequence. | *Arabidopsis thaliana* | 38,732 | Mar. 12, 1997 |
| | | GB_PL1:AB026648 | 43481 | AB026648 | *Arabidopsis thaliana* genomic DNA, chromosome 3, P1 clone: MLJ15, complete sequence. | *Arabidopsis thaliana* | 38,732 | May 7, 1999 |
| rxa00682 | 2022 | GB_HTG3:AC010325 | 197110 | AC010325 | *Homo sapiens* chromosome 19 clone CITB-E1_2568A17, *** SEQUENCING IN PROGRESS ***, 40 unordered pieces. | *Homo sapiens* | 37,976 | Sep. 15, 1999 |
| | | GB_HTG3:AC010325 | 197110 | AC010325 | *Homo sapiens* chromosome 19 clone CITB-E1_2568A17, *** SEQUENCING IN PROGRESS ***, 40 unordered pieces. | *Homo sapiens* | 37,976 | Sep. 15, 1999 |
| rxa00683 | 1215 | GB_PR4:AC008179 | 181745 | AC008179 | *Homo sapiens* clone NH0576F01, complete sequence. | *Homo sapiens* | 37,143 | Sep. 28, 1999 |
| | | GB_BA2:AE000896 | 10707 | AE000896 | *Methanobacterium thermoautotrophicum* from bases 1189349 to 1200055 (section 102 of 148) of the complete genome. | *Methanobacterium thermoautotrophicum* | 38,429 | Nov. 15, 1997 |
| | | GB_IN1:DMBR7A4 | 212734 | AL109630 | *Drosophila melanogaster* clone BACR7A4. | *Drosophila melanogaster* | 36,454 | Jul. 30, 1999 |
| | | GB_EST35:AV163010 | 273 | AV163010 | AV163010 *Mus musculus* head C57BL/6J 13-day embryo *Mus musculus* cDNA clone 3110006I22, mRNA sequence. | *Mus musculus* | 41,758 | Jul. 8, 1999 |
| rxa00686 | 927 | GB_HTG2:HSD137K2 | 190223 | AL049820 | *Homo sapiens* chromosome 6 clone RP1-137K2 map q25.1-25.3, ****SEQUENCING IN PROGRESS ***, in unordered pieces. | *Homo sapiens* | 38,031 | Dec. 3, 1999 |
| | | GB_HTG2:HSD137K2 | 190223 | AL049820 | *Homo sapiens* chromosome 6 clone RP1-137K2 map q25.1-25.3, *** SEQUENCING IN PROGRESS ***, in unordered pieces. | *Homo sapiens* | 38,031 | Dec. 3, 1999 |
| | | GB_EST12:AA284399 | 431 | AA284399 | zs57b04.r1 NCI_CGAP_GCB1 *Homo sapiens* cDNA clone IMAGE:701551 5′, mRNA sequence. | *Homo sapiens* | 39,205 | Aug. 14, 1997 |
| rxa00700 | 927 | GB_EST34:AI785570 | 454 | AI785570 | uj44d03.x1 Sugano mouse liver mlia *Mus musculus* cDNA clone IMAGE:1922789 3′ similar to gb:Z28407 60S RIBOSOMAL PROTEIN L8 (HUMAN); mRNA sequence. | *Mus musculus* | 41,943 | Jul. 2, 1999 |
| | | GB_EST25:AI256147 | 684 | AI256147 | ui95e12.x1 Sugano mouse liver mila *Mus musculus* cDNA clone IMAGE:1890190 3′ similar to gb:Z28407 60S RIBOSOMAL PROTEIN L8 (HUMAN); mRNA sequence. | *Mus musculus* | 40,791 | Nov. 12, 1998 |
| rxa00703 | 2409 | GB_BA1:CARCG12 | 2079 | X14979 | *C. aurantiacus* reaction center genes 1 and 2. | *Chloroflexus aurantiacus* | 37,721 | Apr. 23, 1991 |
| | | GB_BA1:SC7H2 | 42655 | AL109732 | *Streptomyces coelicolor* cosmid 7H2. | *Streptomyces coelicolor* A3(2) | 56,646 | Aug. 2, 1999 |
| | | GB_BA1:MTCY274 | 39991 | Z74024 | *Mycobacterium tuberculosis* H37Rv complete genome; segment 126/162. | *Mycobacterium tuberculosis* | 37,369 | Jun. 19, 1998 |
| | | GB_BA2:REU60056 | 2520 | U60056 | *Ralstonia eutropha* formate dehydrogenase-like protein (cbbBc) gene, complete cds. | *Ralstonia eutropha* | 51,087 | Oct. 16, 1996 |
| rxa00705 | 1038 | GB_GSS15:AQ604477 | 505 | AQ604477 | HS_2116_B1_G07_MR CIT Approved Human Genomic Sperm Library D *Homo sapiens* genomic clone Plate = 2116 Col = 13 Row = N, genomic survey sequence. | *Homo sapiens* | 39,617 | Jun. 10, 1999 |
| | | GB_EST11:AA224340 | 443 | AA224340 | zr14e07.s1 Stratagene hNT neuron (#937233) *Homo sapiens* cDNA clone IMAGE:648804 3′; mRNA sequence. | *Homo sapiens* | 35,129 | Mar. 11, 1998 |
| | | GB_EST5:N30648 | 291 | N30648 | yw77b02.s1 Soares_placenta_8to9weeks_2NbHP8to9W *Homo sapiens* cDNA clone IMAGE:258219 3′; mRNA sequence. | *Homo sapiens* | 43,986 | Jan. 5, 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00782 | 1005 | GB_BA1:MTCY10D7 | 39800 | Z79700 | *Mycobacterium tuberculosis* H37Rv complete genome; segment 44/162. | *Mycobacterium tuberculosis* | 53,327 | Jun. 17, 1998 |
| | | GB_BA1:MLCL373 | 37304 | AL035500 | *Mycobacterium leprae* cosmid L373. | *Mycobacterium leprae* | 62,300 | Aug. 27, 1999 |
| | | GB_BA2:AF128399 | 2842 | AF128399 | *Pseudomonas aeruginosa* succinyl-CoA synthetase beta subunit (sucC) and succinyl CoA synthetase alpha subunit (sucD) genes, complete cds. | *Pseudomonas aeruginosa* | 53,698 | Mar. 25, 1999 |
| rxa00783 | 1395 | GB_HTG2:AC008158 | 118792 | AC008158 | *Homo sapiens* chromosome 17 clone hRPK.42_F_20 map 17, *** SEQUENCING IN PROGRESS ***, 14 unordered pieces. | *Homo sapiens* | 35,135 | Jul. 28, 1999 |
| | | GB_HTG2:AC008158 | 118792 | AC008158 | *Homo sapiens* chromosome 17 clone hRPK.42_F_20 map 17, *** SEQUENCING IN PROGRESS ***, 14 unordered pieces. | *Homo sapiens* | 35,135 | Jul. 28, 1999 |
| rxa00794 | 1128 | GB_PR3:AC005017 | 137176 | AC005017 | *Homo sapiens* BAC clone GS214N13 from 7p14-p15, complete sequence. | *Homo sapiens* | 35,864 | Aug. 8, 1998 |
| | | GB_BA1:MTV017 | 67200 | AL021897 | *Mycobacterium tuberculosis* H37Rv complete genome; segment 48/162. | *Mycobacterium tuberculosis* | 40,331 | Jun. 24, 1999 |
| | | GB_BA1:MLCB1222 | 34714 | AL049491 | *Mycobacterium leprae* cosmid B1222. | *Mycobacterium leprae* | 61,170 | Aug. 27, 1999 |
| | | GB_PR2:HS151B14 | 128942 | Z82188 | Human DNA sequence from clone 151B14 on chromosome 22 Contains SOMATOSTATIN RECEPTOR TYPE 3 (SS3R) gene, pseudogene similar to ribosomal protein L39, RAC2 (RAS-RELATED C3 BOTULINUM TOXIN SUBTRATE 2 (P21-RAC2)) gene ESTs, STSs, GSSs and CpG islands, complete sequence. | *Homo sapiens* | 37,455 | Jun. 16, 1999 |
| rxa00799 | 1767 | GB_PL2:AF016327 | 616 | AF016327 | *Hordeum vulgare* Barperm1 (perm1) mRNA, partial cds. | *Hordeum vulgare* | 41,311 | Oct. 1, 1997 |
| | | GB_HTG2:HSDJ319M7 | 128208 | AL079341 | *Homo sapiens* chromosome 6 clone RP1-319M7 map p21.1-21.3, *** SEQUENCING IN PROGRESS ***, in unordered pieces. | *Homo sapiens* | 36,845 | Nov. 30, 1999 |
| | | GB_HTG2:HSDJ319M7 | 128208 | AL079341 | *Homo sapiens* chromosome 6 clone RP1-319M7 map p21.1-21.3, *** SEQUENCING IN PROGRESS ***, in unordered pieces. | *Homo sapiens* | 36,845 | Nov. 30, 1999 |
| rxa00800 | 1227 | GB_BA1:MTV022 | 13025 | AL021925 | *Mycobacterium tuberculosis* H37Rv complete genome; segment 100/162. | *Mycobacterium tuberculosis* | 63,101 | Jun. 17, 1998 |
| | | GB_BA1:AB019513 | 4417 | AB019513 | *Streptomyces coelicolor* genes for alcohol dehydrogenase and ABC transporter, complete cds. | *Streptomyces coelicolor* | 41,312 | Nov. 13, 1998 |
| rxa00825 | 1056 | GB_PL1:SCSFAARP | 7008 | X68020 | *S. cerevisiae* SFA and ARP genes. | *Saccharomyces cerevisiae* | 36,288 | Nov. 29, 1994 |
| | | GB_BA1:MTY15C10 | 33050 | Z95436 | *Mycobacterium tuberculosis* H37Rv complete genome; segment 154/162. | *Mycobacterium tuberculosis* | 39,980 | Jun. 17, 1998 |
| | | GB_BA1:MLCB2548 | 38916 | AL023093 | *Mycobacterium leprae* cosmid B2548. | *Mycobacterium leprae* | 39,435 | Aug. 27, 1999 |
| | | GB_BA2:AF169031 | 1141 | AF169031 | *Xanthomonas oryzae* pv. oryzae putative sugar nucleotide epimerase/dehyratase gene, partial cds | *Xanthomonas oryzae* pv. oryzae | 46,232 | Sep. 14, 1999 |
| rxa00871 | | | | | | | | |
| rxa00872 | 1077 | GB_IN1:CEF23H12 | 35564 | Z74472 | *Caenorhabditis elegans* cosmid F23H12, complete sequence. | *Caenorhabditis elegans* | 34,502 | Oct. 8, 1999 |
| | | GB_HTG2:AC007263 | 167390 | AC007263 | *Homo sapiens* chromosome 14 clone BAc 79J20 map 14q31, *** SEQUENCING IN PROGRESS ***, 5 ordered pieces. | *Homo sapiens* | 35,714 | May 24, 1999 |
| | | GB_HTG2:AC007263 | 167390 | AC007263 | *Homo sapiens* chromosome 14 clone BAc 79J20 map 14q31, *** SEQUENCING IN PROGRESS ***, 5 ordered pieces. | *Homo sapiens* | 35,714 | May 24, 1999 |
| rxa00879 | 2241 | GB_BA1:MTV049 | 40360 | AL022021 | *Mycobacterium tuberculosis* H37Rv complete genome; segment 81/162. | *Mycobacterium tuberculosis* | 36,981 | Jun. 19, 1998 |
| | | GB_PL2:CDU236897 | 1827 | AJ236897 | *Candida dubliniensis* ACT1 gene, exons 1-2. | *Candida dubliniensis* | 38,716 | Sep. 1, 1999 |
| | | GB_PL1:CAACT1A | 3206 | X16377 | *Candida albicans* act1 gene for actin. | *Candida albicans* | 36,610 | Apr. 10, 1993 |
| rxa00909 | 955 | GB_BA2:AF010496 | 189370 | AF010496 | *Rhodobacter capsulatus* strain SB1003, partial genome. | *Rhodobacter capsulatus* | 51,586 | May 12, 1998 |
| | | GB_BA1:RMPHA | 7888 | X93358 | *Rhizobium meliloti* pha[A, B, C, D, E, F, G] genes. | *Sinorhizobium meliloti* | 48,367 | Mar. 12, 1999 |
| | | GB_EST16:C23528 | 317 | C23528 | C23528 Japanese flounder spleen *Paralichthys olivaceus* cDNA clone HB5(2). mRNA sequence. | *Paralichthys olivaceus* | 41,640 | Sep. 28, 1999 |

TABLE 4-continued

ALIGNMENT RESULTS

| ID # | length (NT) | Genbank Hit | Accession | Name of Genbank Hit | Source of Genbank Hit | % homology (GAP) | Date of Deposit |
|---|---|---|---|---|---|---|---|
| rxa00913 | 2118 | GB_HTG2:AC007734 | AC007734 | *Homo sapiens* chromosome 18 clone hRPK.44_O_1 map 18, *** SEQUENCING IN PROGRESS ***, 18 unordered pieces. | *Homo sapiens* | 34,457 | Jun. 5, 1999 |
| | | GB_HTG2:AC007734 | AC007734 | *Homo sapiens* chromosome 18 clone hRPK.44_O_1 map 18, *** SEQUENCING IN PROGRESS ***, 18 unordered pieces. | *Homo sapiens* | 34,457 | Jun. 5, 1999 |
| | | GB_EST18:AA709478 | AA709478 | vv34a05.r1 Stratagene mouse heart (#937316) *Mus musculus* cDNA clone IMAGE:1224272 5', mRNA sequence. | *Mus musculus* | 42,065 | Dec. 24, 1997 |
| rxa00945 | 1095 | GB_HTG4:AC010351 | AC010351 | *Homo sapiens* chromosome 5 clone CITB-H1_2022B6, *** SEQUENCING IN PROGRESS ***, 68 unordered pieces. | *Homo sapiens* | 36,448 | Oct. 31, 1999 |
| | | GB_HTG4:AC010351 | AC010351 | *Homo sapiens* chromosome 5 clone CITB-H1_2022B6, *** SEQUENCING IN PROGRESS ***, 68 unordered pieces. | *Homo sapiens* | 36,448 | Oct. 31, 1999 |
| rxa00965 | | GB_BA1:MTCY05A6 | Z96072 | *Mycobacterium tuberculosis* H37Rv complete genome; segment 120/162. | *Mycobacterium tuberculosis* | 36,218 | Jun. 17, 1998 |
| rxa00999 | 1575 | GB_PAT:E13660 | E13660 | gDNA encoding 6-phosphogluconate dehydrogenase. | *Corynebacterium glutamicum* | 98,349 | Jun. 24, 1998 |
| | | GB_BA1:MTCY359 | Z83859 | *Mycobacterium tuberculosis* H37Rv complete genome; segment 84/162. | *Mycobacterium tuberculosis* | 38,520 | Jun. 17, 1998 |
| | | GB_BA1:MLCB1788 | AL008609 | *Mycobacterium leprae* cosmid B1788. | *Mycobacterium leprae* | 64,355 | Aug. 27, 1999 |
| rxa01015 | 442 | GB_BA1:MTV008 | AL021246 | *Mycobacterium tuberculosis* H37Rv complete genome; segment 108/162. | *Mycobacterium tuberculosis* | 39,860 | Jun. 17, 1998 |
| | | GB_BA1:MTV008 | AL021246 | *Mycobacterium tuberculosis* H37Rv complete genome; segment 108/162. | *Mycobacterium tuberculosis* | 39,120 | Jun. 17, 1998 |
| rxa01025 | 1119 | GB_BA1:SC7A1 | AL034447 | *Streptomyces coelicolor* cosmid 7A1. | *Streptomyces coelicolor* | 55,287 | Dec. 15, 1998 |
| | | GB_BA1:MSGB1723CS | L78825 | *Mycobacterium leprae* cosmid B1723 DNA sequence. | *Mycobacterium leprae* | 56,847 | Jun. 15, 1996 |
| | | GB_BA1:MLCB637 | Z99263 | *Mycobacterium leprae* cosmid B637. | *Mycobacterium leprae* | 56,676 | Sep. 17, 1997 |
| rxa01048 | 1347 | GB_BA2:AF017444 | AF017444 | *Sinorhizobium meliloti* NADP-dependent malic enzyme (tme) gene, complete cds. | *Sinorhizobium meliloti* | 53,660 | Nov. 2, 1997 |
| | | GB_BA1:BSUB0013 | Z99116 | *Bacillus subtilis* complete genome (section 13 of 21): from 2395261 to 2613730. | *Bacillus subtilis* | 37,255 | Nov. 26, 1997 |
| | | GB_VI:HSV2HG52 | Z86099 | Herpes simplex virus type 2 (strain HG52), complete genome. | human herpesvirus 2 | 38,081 | Dec. 4, 1998 |
| rxa01049 | 1605 | GB_HTG2:AC002518 | AC002518 | *Homo sapiens* chromosome X clone bWXD20, *** SEQUENCING IN PROGRESS ***, 11 unordered pieces. | *Homo sapiens* | 35,647 | Sep. 2, 1997 |
| | | GB_HTG2:AC002518 | AC002518 | *Homo sapiens* chromosome X clone bWXD20, *** SEQUENCING IN PROGRESS ***, 11 unordered pieces. | *Homo sapiens* | 35,647 | Sep. 2, 1997 |
| | | GB_HTG2:AC002518 | AC002518 | *Homo sapiens* chromosome X clone bWXD20, *** SEQUENCING IN PROGRESS ***, 11 unordered pieces. | *Homo sapiens* | 26,180 | Sep. 2, 1997 |
| rxa01077 | 1494 | GB_PR3:HSDJ653C5 | AL049743 | Human DNA sequence from clone 653C5 on chromosome 1p21.3-22.3 Contains CA repeat(D1S435), STSs and GSSs, complete sequence. | *Homo sapiens* | 36,462 | Nov. 23, 1999 |
| | | GB_BA1:ECU29579 | U29579 | *Escherichia coli* K-12 genome; approximately 61 to 62 minutes. | *Escherichia coli* | 41,808 | Jul. 1, 1995 |
| | | GB_BA1:ECU29579 | U29579 | *Escherichia coli* K-12 genome; approximately 61 to 62 minutes. | *Escherichia coli* | 36,130 | Jul. 1, 1995 |
| rxa01089 | 873 | GB_GSS8:AQ044021 | AQ044021 | CIT-HSP-2318C18.TR CIT-HSP *Homo sapiens* genomic clone 2318C18, genomic survey sequence. | *Homo sapiens* | 36,528 | Jul. 14, 1998 |
| | | GB_GSS8:AQ042907 | AQ042907 | CIT-HSP-2318D17.TR CIT-HSP *Homo sapiens* genomic clone 2318D17, genomic survey sequence. | *Homo sapiens* | 35,969 | Jul. 14, 1998 |
| | | GB_GSS8:AQ044021 | AQ044021 | CIT-HSP-2318C18.TR CIT-HSP *Homo sapiens* genomic clone 2318C18, genomic survey sequence. | *Homo sapiens* | 44,545 | Jul. 14, 1998 |
| rxa01093 | 1554 | GB_BA1:CORPYKI | L27126 | *Corynebacterium* pyruvate kinase gene, complete cds. | *Corynebacterium glutamicum* | 100,000 | Dec. 7, 1994 |
| | | GB_BA1:MTCY01B2 | Z95554 | *Mycobacterium tuberculosis* H37Rv complete genome; segment 72/162. | *Mycobacterium tuberculosis* | 63,771 | Jun. 17, 1998 |
| | | GB_BA1:MIU65430 | U65430 | *Mycobacterium intracellulare* pyruvate kinase (pykF) gene, complete cds. | *Mycobacterium intracellulare* | 67,071 | Dec. 23, 1996 |
| rxa01099 | 948 | GB_BA2:AF045998 | AF045998 | *Corynebacterium glutamicum* inositol monophosphate phosphatase (impA) gene, complete cds. | *Corynebacterium glutamicum* | 99,615 | Feb. 19, 1998 |
| | | GB_BA2:AF051846 | AF051846 | *Corynebacterium glutamicum* phosphoribosylformimino-5-amino-1-phosphoribosyl-4-imidazolecarboxamide isomerase (hisA) gene, complete cds. | *Corynebacterium glutamicum* | 100,000 | Mar. 12, 1998 |
| | | GB_GSS1:FR0005503 | Z89313 | *F. rubripes* GSS sequence, clone 079B16aE8, genomic survey sequence. | *Fugu rubripes* | 37,785 | Mar. 1, 1997 |

TABLE 4-continued

ALIGNMENT RESULTS

| ID # | length (NT) | Genbank Hit | Length Accession | Name of Genbank Hit | Source of Genbank Hit | % homology (GAP) | Date of Deposit |
|---|---|---|---|---|---|---|---|
| rxa01111 | 541 | GB_PR3:AC004063 | 177014 AC004063 | *Homo sapiens* chromosome 4 clone B3218, complete sequence. | *Homo sapiens* | 35,835 | Jul. 10, 1998 |
| | | GB_PR3:H51178121 | 62268 AL109852 | Human DNA sequence from clone RP5-1178121 on chromosome X, complete sequence. | *Homo sapiens* | 37,873 | Dec. 1, 1999 |
| rxa01130 | 687 | GB_HTG3:AC009301 | 163369 AC009301 | *Homo sapiens* clone NH0062F14, *** SEQUENCING IN PROGRESS ***, 5 unordered pieces. | *Homo sapiens* | 37,420 | Aug. 13, 1999 |
| | | GB_HTG3:AC009444 | 164587 AC009444 | *Homo sapiens* clone 1_O_3, *** SEQUENCING IN PROGRESS ***, 8 unordered pieces. | *Homo sapiens* | 38,416 | Aug. 22, 1999 |
| | | GB_HTG3:AC009444 | 164587 AC009444 | *Homo sapiens* clone 1_O_3, *** SEQUENCING IN PROGRESS ***, 8 unordered pieces. | *Homo sapiens* | 38,416 | Aug. 22, 1999 |
| rxa01193 | 1572 | GB_IN1:DMC66A1 | 34127 AL031227 | *Drosophila melanogaster* cosmid 66A1. | *Drosophila melanogaster* | 38,416 | Oct. 5, 1998 |
| | | GB_BA1:CGASO19 | 1452 X76875 | *C. glutamicum* (ASO 19) ATPase beta-subunit gene. | *Corynebacterium glutamicum* | 99,931 | Oct. 27, 1994 |
| | | EM_PAT:E09634 | 1452 E09634 | *Brevibacterium flavum* UncD gene whose gene product is involved in | *Corynebacterium glutamicum* | 99,242 | Oct. 7, 1997 (Rel. 52, Created) |
| rxa01194 | 495 | GB_BA1:MLU15186 | 36241 U15186 | *Mycobacterium leprae* cosmid L471. | *Mycobacterium leprae* | 39,153 | Mar. 9, 1995 |
| | | EM_PAT:E09634 | 1452 E09634 | *Brevibacterium flavum* UncD gene whose gene product is involved in | *Corynebacterium glutamicum* | 100,000 | Oct. 7, 1997 (Rel. 52, Created) |
| | | GB_BA1:CGASO19 | 1452 X76875 | *C. glutamicum* (ASO 19) ATPase beta-subunit gene. | *Corynebacterium glutamicum* | 100,000 | Oct. 27, 1994 |
| | | GB_VI:HEPCRE4B | 414 X60570 | Hepatitis C genomic RNA for putative envelope protein (RE4B isolate). | Hepatitis C virus | 36,769 | Apr. 5, 1992 |
| rxa01200 | | | | | | | |
| rxa01201 | 1764 | GB_BA1:SLATPSYNA | 8560 Z22606 | *S. lividans* i protein and ATP synthase genes. | *Streptomyces lividans* | 66,269 | May 1, 1995 |
| | | GB_BA1:MTCY373 | 35516 Z73419 | *Mycobacterium tuberculosis* H37Rv complete genome; segment 57/162. | *Mycobacterium tuberculosis* | 65,437 | Jun. 17, 1998 |
| | | GB_BA1:MLU15186 | 36241 U15186 | *Mycobacterium leprae* cosmid L471. | *Mycobacterium leprae* | 39,302 | Mar. 9, 1995 |
| rxa01202 | 1098 | GB_BA1:SLATPSYNA | 8560 Z22606 | *S. lividans* i protein and ATP synthase genes. | *Streptomyces lividans* | 57,087 | May 1, 1995 |
| | | GB_BA1:SLATPSYNA | 8560 Z22606 | *S. lividans* i protein and ATP synthase genes. | *Streptomyces lividans* | 38,298 | May 1, 1995 |
| | | GB_BA1:MCSQSSHC | 5538 Y09978 | *M. capsulatus* orfx, orfy, orfz, sqs and shc genes. | *Methylococcus capsulatus* | 37,626 | May 26, 1998 |
| rxa01204 | 933 | GB_PL1:AP000423 | 154478 AP000423 | *Arabidopsis thaliana* chloroplast genomic DNA, complete sequence, strain:Columbia. Chloroplast | *Arabidopsis thaliana* | 38,395 | Sep. 15, 1999 |
| | | GB_HTG6:AC009762 | 164070 AC009762 | *Homo sapiens* clone RP11-114I16, *** SEQUENCING IN PROGRESS ***, 39 unordered pieces. | *Homo sapiens* | 35,459 | Dec. 4, 1999 |
| | | GB_HTG6:AC009762 | 164070 AC009762 | *Homo sapiens* clone RP11-114I16, *** SEQUENCING IN PROGRESS ***, 39 unordered pieces. | *Homo sapiens* | 36,117 | Dec. 4, 1999 |
| rxa01216 | 1124 | GB_BA1:MTCY10G2 | 38970 Z92539 | *Mycobacterium tuberculosis* H37Rv complete genome; segment 47/162. | *Mycobacterium tuberculosis* | 39,064 | Jun. 17, 1998 |
| | | GB_BA2:AF017435 | 4301 AF017435 | *Methylobacterium extorquens* methanol oxidation genes, glmU-like gene, partial cds. and orfL2, orfL1, orfR genes, complete cds. | *Methylobacterium extorquens* | 42,671 | Mar. 10, 1998 |
| | | GB_BA1:CCRFLBDBA | 4424 M69228 | *C. crescentus* flagellar gene promoter region. | *Caulobacter crescentus* | 41,054 | Apr. 26, 1993 |
| rxa01225 | 1563 | GB_BA2:AF058302 | 25306 AF058302 | *Streptomyces roseofulvus* frenolicin biosynthetic gene cluster, complete sequence. | *Streptomyces roseofulvus* | 36,205 | Jun. 2, 1998 |
| | | GB_HTG3:AC007301 | 165741 AC007301 | *Drosophila melanogaster* chromosome 2 clone BACR04B09 (D576) RPCI-98 04.B.9 map 43E12-44F1 strain y; cn bw sp, *** SEQUENCING IN PROGRESS ***, 150 unordered pieces. | *Drosophila melanogaster* | 39,922 | Aug. 17, 1999 |
| | | GB_HTG3:AC007301 | 165741 AC007301 | *Drosophila melanogaster* chromosome 2 clone BACR04B09 (D576) RPCI-98 04.B.9 map 43E12-44F1 strain y; cn bw sp, *** SEQUENCING IN PROGRESS ***, 150 unordered pieces. | *Drosophila melanogaster* | 39,922 | Aug. 17, 1999 |
| rxa01227 | 444 | GB_BA1:SERFDXA | 3869 M61119 | *Saccharopolyspora erythraea* ferredoxin (fdxA) gene, complete cds. | *Saccharopolyspora erythraea* | 64,908 | Mar. 13, 1996 |
| | | GB_BA1:MTV005 | 37840 AL010186 | *Mycobacterium tuberculosis* H37Rv complete genome; segment 51/162. | *Mycobacterium tuberculosis* | 62,838 | Jun. 17, 1998 |
| | | GB_BA1:MSGY348 | 40056 AD000020 | *Mycobacterium tuberculosis* sequence from clone y348. | *Mycobacterium tuberculosis* | 61,712 | Dec. 10, 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01242 | 900 | GB_PR3:AC005697 | 174503 | AC005697 | *Homo sapiens* chromosome 17, clone hRPK.138_P_22, complete sequence. | *Homo sapiens* | 35,373 | Oct. 9, 1998 |
| | | GB_HTG3:AC010722 | 160723 | AC010722 | *Homo sapiens* clone NH0122L09, *** SEQUENCING IN PROGRESS ***, 2 unordered pieces. | *Homo sapiens* | 39,863 | Sep. 25, 1999 |
| | | GB_HTG3:AC010722 | 160723 | AC010722 | *Homo sapiens* clone NH0122L09, *** SEQUENCING IN PROGRESS ***, 2 unordered pieces. | *Homo sapiens* | 39,863 | Sep. 25, 1999 |
| rxa01243 | 1083 | GB_GSS10:AQ255057 | 583 | AQ255057 | mgxb0008N01r CUGI Rice Blast BAC Library *Magnaporthe grisea* genomic mgxb0008N01r, genomic survey sequence. | *Magnaporthe grisea* | 38,722 | Oct. 23, 1998 |
| | | GB_IN1:CEK05D4 | 19000 | Z92804 | *Caenorhabditis elegans* cosmid K05D4, complete sequence. | *Caenorhabditis elegans* | 35,448 | Nov. 23, 1998 |
| | | GB_IN1:CEK05D4 | 19000 | Z92804 | *Caenorhabditis elegans* cosmid K05D4, complete sequence. | *Caenorhabditis elegans* | 35,694 | Nov. 23, 1998 |
| rxa01259 | 981 | GB_BA1:CGLPD | 1800 | Y16642 | *Corynebacterium glutamicum* lpd gene, complete CDS. | *Corynebacterium glutamicum* | 100,000 | Feb. 1, 1999 |
| | | GB_HTG4:AC010567 | 143287 | AC010567 | *Drosophila melanogaster* chromosome 3L/69C1 clone RPCI98-11N6, *** SEQUENCING IN PROGRESS ***, 70 unordered pieces. | *Drosophila melanogaster* | 37,178 | Oct. 16, 1999 |
| | | GB_HTG4:AC010567 | 143287 | AC010567 | *Drosophila melanogaster* chromosome 3L/69C1 clone RPCI98-11N6, *** SEQUENCING IN PROGRESS ***, 70 unordered pieces. | *Drosophila melanogaster* | 37,178 | Oct. 16, 1999 |
| rxa01262 | 1284 | GB_BA2:AF172324 | 14263 | AF172324 | *Escherichia coli* GalF (galF) gene, partial cds; O-antigen repeat unit transporter Wzx (wzx), WbnA (wbnA), O-antigen polymerase Wzy (wzy), WbnB (wbnB), WbnC (wbnC), WbnD (wbnD), WbnE (wbnE), UDP-Glc-4-epimerase GalE (galE), 6-phosphogluconate dehydrogenase Gnd (gnd), UDP-Glc-6-dehydrogenase Ugd (ugd), and WbnF (wbnF) genes, complete cds; and chain length determinant Wzz (wzz) gene, partial cds. | *Escherichia coli* | 59,719 | Oct. 29, 1999 |
| | | GB_BA2:ECU78086 | 4759 | U78086 | *Escherichia coli* hypothetical uridine-5'-diphosphoglucose dehydrogenase (ugd) and O-chain length regulator (wzz) genes, complete cds. | *Escherichia coli* | 59,735 | Nov. 5, 1997 |
| | | GB_BA1:D90841 | 20226 | D90841 | *E. coli* genomic DNA, Kohara clone #351(45.1-45.5 min.). | *Escherichia coli* | 37,904 | Mar. 21, 1997 |
| | | GB_PR3:AC004103 | 144368 | AC004103 | *Homo sapiens* Xp22 BAC GS-61913 (Genome Systems Human BAC library) complete sequence. | *Homo sapiens* | 37,340 | Apr. 18, 1998 |
| rxa01311 | 870 | GB_HTG3:AC007383 | 215529 | AC007383 | *Homo sapiens* clone NH0310K15, *** SEQUENCING IN PROGRESS ***, 4 unordered pieces. | *Homo sapiens* | 36,385 | Sep. 25, 1999 |
| | | GB_HTG3:AC007383 | 215529 | AC007383 | *Homo sapiens* clone NH0310K15, *** SEQUENCING IN PROGRESS ***, 4 unordered pieces. | *Homo sapiens* | 36,385 | Sep. 25, 1999 |
| rxa01312 | 2142 | GB_BA2:AE000487 | 13889 | AE000487 | *Escherichia coli* K-12 MG1655 section 377 of 400 of the complete genome. | *Escherichia coli* | 39,494 | Nov. 12, 1998 |
| | | GB_BA1:MTV016 | 53662 | AL021841 | *Mycobacterium tuberculosis* H37Rv complete genome; segment 143/162. | *Mycobacterium tuberculosis* | 46,252 | Jun. 23, 1999 |
| | | GB_BA1:U00022 | 36411 | U00022 | *Mycobacterium leprae* cosmid L308. | *Mycobacterium leprae* | 46,368 | Mar. 1, 1994 |
| rxa01325 | 795 | GB_HTG4:AC009245 | 215767 | AC009245 | *Homo sapiens* chromosome 7, *** SEQUENCING IN PROGRESS ***, 24 unordered pieces. | *Homo sapiens* | 36,016 | Nov. 2, 1999 |
| | | GB_HTG4:AC009245 | 215767 | AC009245 | *Homo sapiens* chromosome 7, *** SEQUENCING IN PROGRESS ***, 24 unordered pieces. | *Homo sapiens* | 36,016 | Nov. 2, 1999 |
| | | GB_HTG4:AC009245 | 215767 | AC009245 | *Homo sapiens* chromosome 7, *** SEQUENCING IN PROGRESS ***, 24 unordered pieces. | *Homo sapiens* | 39,618 | Nov. 2, 1999 |
| rxa01332 | 576 | GB_HTG6:AC007186 | 225851 | AC007186 | *Drosophila melanogaster* chromosome 2 clone BACR03D06 (D569) RPCI-99 03.D.6 map 32A-32A strain y; cn bw sp, *** SEQUENCING IN PROGRESS ***, 91 unordered pieces. | *Drosophila melanogaster* | 35,366 | Dec. 7, 1999 |
| | | GB_HTG6:AC007147 | 202291 | AC007147 | *Drosophila melanogaster* chromosome 2 clone BACR19N18 (D572) RPCI-98 19.N.18 map 32A-32A strain y; cn bw sp, *** SEQUENCING IN PROGRESS ***, 22 unordered pieces. | *Drosophila melanogaster* | 36,366 | Dec. 7, 1999 |
| | | GB_HTG3:AC010207 | 207890 | AC010207 | *Homo sapiens* clone RPCI11-375J20, *** SEQUENCING IN PROGRESS ***, 25 unordered pieces. | *Homo sapiens* | 34,821 | Sep. 16, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01350 | 1107 | GB_BA2:AF109682 | 990 | AF109682 | *Aquaspirillum arcticum* malate dehydrogenase (MDH) gene, complete cds. | *Aquaspirillum arcticum* | 58,487 | Oct. 19, 1999 |
| | | GB_HTG2:AC006759 | 103725 | AC006759 | *Caenorhabditis elegans* clone Y40G12, *** SEQUENCING IN PROGRESS ***, 8 unordered pieces. | *Caenorhabditis elegans* | 37,963 | Feb. 25, 1999 |
| | | GB_HTG2:AC006759 | 103725 | AC006759 | *Caenorhabditis elegans* clone Y40G12, *** SEQUENCING IN PROGRESS ***, 8 unordered pieces. | *Caenorhabditis elegans* | 37,963 | Feb. 25, 1999 |
| rxa01365 | 1497 | GB_BA1:MTY20B11 | 36330 | Z95121 | *Mycobacterium tuberculosis* H37Rv complete genome; segment 139/162. | *Mycobacterium tuberculosis* | 38,011 | Jun. 17, 1998 |
| | | GB_BA1:XANXANAB | 3410 | M83231 | *Xanthomonas campestris* phosphoglucomutase and phosphomannomutase (xanA) and phosphomannose isomerase and GDP-mannose pyrophosphorylase (xanB) genes, complete cds. | *Xanthomonas campestris* | 47,726 | Apr. 26, 1993 |
| | | GB_GSS10:AQ194038 | 697 | AQ194038 | RPCI11-47D24.TJ RPCI-11 *Homo sapiens* genomic clone RPCI-11-47D24, genomic survey sequence. | *Homo sapiens* | 36,599 | Apr. 20, 1999 |
| rxa01369 | 1305 | GB_BA1:MTY20B11 | 36330 | Z95121 | *Mycobacterium tuberculosis* H37Rv complete genome; segment 139/162. | *Mycobacterium tuberculosis* | 36,940 | Jun. 17, 1998 |
| | | GB_GSS3:B10037 | 974 | B10037 | T27A19-T7 TAMU *Arabidopsis thaliana* genomic clone T27A19, genomic survey sequence. | *Arabidopsis thaliana* | 35,284 | May 14, 1997 |
| | | GB_GSS3:B09549 | 1097 | B09549 | T21A19-T7.1 TAMU *Arabidopsis thaliana* genomic clone T21A19, genomic survey sequence. | *Arabidopsis thaliana* | 38,324 | May 14, 1997 |
| rxa01377 | 1209 | GB_BA1:MTCY71 | 42729 | Z92771 | *Mycobacterium tuberculosis* H37Rv complete genome; segment 141/162. | *Mycobacterium tuberculosis* | 39,778 | Feb. 10, 1999 |
| | | GB_HTG5:AC007547 | 262181 | AC007547 | *Homo sapiens* clone RP11-252O18, WORKING DRAFT SEQUENCE, 121 unordered pieces. | *Homo sapiens* | 32,658 | Nov. 16, 1999 |
| | | GB_HTG5:AC007547 | 262181 | AC007547 | *Homo sapiens* clone RP11-252O18, WORKING DRAFT SEQUENCE, 121 unordered pieces. | *Homo sapiens* | 38,395 | Nov. 16, 1999 |
| rxa01392 | 1200 | GB_BA2:AF072709 | 8366 | AF072709 | *Streptomyces lividans* amplifiable element AUD4: putative transcriptional regulator, putative ferredoxin, putative cytochrome P450 oxidoreductase, and putative oxidoreductase genes, complete cds; and unknown genes. | *Streptomyces lividans* | 55,221 | Jul. 8, 1998 |
| | | GB_BA1:CGLYSEG | 2374 | X96471 | *C. glutamicum* lysE and lysG genes. | *Corynebacterium glutamicum* | 100,000 | Feb. 24, 1997 |
| | | GB_PR4:AC005906 | 185952 | AC005906 | *Homo sapiens* 12p13.3 BAC RPCI11-429A20 (Roswell Park Cancer Institute Human BAC Library) complete sequence. | *Homo sapiens* | 36,756 | Jan. 30, 1999 |
| rxa01436 | 1314 | GB_BA1:CGPTAACKA | 3657 | X89084 | *C. glutamicum* pta gene and ackA gene. | *Corynebacterium glutamicum* | 100,000 | Mar. 23, 1999 |
| | | GB_BA1:D90861 | 14839 | D90861 | *E. coli* genomic DNA, Kohara clone #405(52.0-52.3 min). | *Escherichia coli* | 53,041 | May 29, 1997 |
| | | GB_PAT1:E02087 | 1200 | E02087 | DNA encoding acetate kinase protein from *Escherichia coli*. | *Escherichia coli* | 54,461 | Sep. 29, 1997 |
| rxa01468 | 948 | GB_GSS1:HPU60627 | 280 | U60627 | *Helicobacter pylori* feoB-like DNA sequence, genomic survey sequence. | *Helicobacter pylori* | 39,286 | Apr. 9, 1997 |
| | | GB_EST31:AI701691 | 349 | AI701691 | we81c04.x1 Soares_NFL_T_GBC_S1 *Homo sapiens* cDNA clone IMAGE:2347494 3' similar to gb:L19686_rna1 MACROPHAGE MIGRATION INHIBITORY FACTOR (HUMAN); mRNA sequence. | *Homo sapiens* | 39,412 | Jun. 3, 1999 |
| | | GB_EST15:AA480256 | 389 | AA480256 | ne31f04.s1 NCI_CGAP_Co3 *Homo sapiens* cDNA clone IMAGE:898975 3' similar to gb:L19686_mal MACROPHAGE MIGRATION INHIBITORY FACTOR (HUMAN); mRNA sequence. | *Homo sapiens* | 39,574 | Aug. 14, 1997 |
| rxa01478 | 1959 | GB_BA1:SC151 | 40745 | AL109848 | *Streptomyces coelicolor* cosmid 151. | *Streptomyces coelicolor* A3(2) | 54,141 | Aug. 16, 1999 |
| | | GB_BA1:SCE36 | 12581 | AL049763 | *Streptomyces coelicolor* cosmid E36. | *Streptomyces coelicolor* | 38,126 | May 5, 1999 |
| | | GB_BA1:CGU43535 | 2531 | U43535 | *Corynebacterium glutamicum* multidrug resistance protein (cmr) gene, complete cds. | *Corynebacterium glutamicum* | 41,852 | Apr. 9, 1997 |
| rxa01482 | 1998 | GB_BA1:SC6G4 | 41055 | AL031317 | *Streptomyces coelicolor* cosmid 6G4. | *Streptomyces coelicolor* | 62,149 | Aug. 20, 1998 |
| | | GB_BA1:U00020 | 36947 | U00020 | *Mycobacterium leprae* cosmid B229. | *Mycobacterium leprae* | 38,303 | Mar. 1, 1994 |
| rxa01534 | | GB_BA1:MTCY77 | 22255 | Z95389 | *Mycobacterium tuberculosis* H37Rv complete genome; segment 146/162. | *Mycobacterium tuberculosis* | 38,179 | Jun. 18, 1998 |

TABLE 4-continued

ALIGNMENT RESULTS

| ID # | length (NT) | Genbank Hit | Accession | Name of Genbank Hit | Source of Genbank Hit | % homology (GAP) | Date of Deposit |
|---|---|---|---|---|---|---|---|
| rxa01535 | 1530 | GB_BA1:MLCB1222 | AL049491 | *Mycobacterium leprae* cosmid B1222. | *Mycobacterium leprae* | 66,208 | Aug. 27, 1999 |
|  |  | GB_BA1:MTV017 | AL021897 | *Mycobacterium tuberculosis* H37Rv complete genome; segment 48/162. | *Mycobacterium tuberculosis* | 38,553 | Jun. 24, 1999 |
|  |  | GB_BA1:PAU72494 | U72494 | *Pseudomonas aeruginosa* fumarase (fumC) and Mn superoxide dismutase (sodA) genes, complete cds. | *Pseudomonas aeruginosa* | 52,690 | Oct. 23, 1996 |
| rxa01550 | 1635 | GB_BA1:D90907 | D90907 | *Synechocystis* sp. PCC6803 complete genome, 9/27, 1056467-1188885. | *Synechocystis* sp. | 56,487 | Feb. 7, 1999 |
|  |  | GB_IN2:AF073177 | AF073177 | *Drosophila melanogaster* glycogen phosphorylase (GlyP) gene, complete cds. | *Drosophila melanogaster* | 55,100 | Jul. 1, 1999 |
|  |  | GB_IN2:AF073179 | AF073179 | *Drosophila melanogaster* glycogen phosphorylase (Glp1) mRNA, complete cds. | *Drosophila melanogaster* | 56,708 | Apr. 27, 1999 |
| rxa01562 |  |  |  |  |  |  |  |
| rxa01569 | 1482 | GB_BA1:D78182 | D78182 | *Streptococcus mutans* DNA for dTDP-rhamnose synthesis pathway, complete cds. | *Streptococcus mutans* | 44,050 | Feb. 5, 1999 |
|  |  | GB_BA2:AF079139 | AF079139 | *Streptomyces venezuelae* pikCD operon, complete sequence. | *Streptomyces venezuelae* | 38,587 | Oct. 28, 1998 |
|  |  | GB_BA2:AF087022 | AF087022 | *Streptomyces venezuelae* cytochrome P450 monooxygenase (picK) gene, complete cds. | *Streptomyces venezuelae* | 38,621 | Oct. 15, 1998 |
| rxa01570 | 978 | GB_BA1:MTCY63 | Z96800 | *Mycobacterium tuberculosis* H37Rv complete genome; segment 16/162. | *Mycobacterium tuberculosis* | 59,035 | Jun. 17, 1998 |
|  |  | GB_BA2:AF097519 | AF097519 | *Klebsiella pneumoniae* dTDP-D-glucose 4,6 dehydratase (rmlB), glucose-1-phosphate thymidylyl transferase (rmlA), dTDP-4-keto-L-rhamnose reductase (rmlD), dTDP-4-keto-6-deoxy-D-glucose 3,5-epimerase (rmlC), and rhamnosyl transferase (wbbL) genes, complete cds. | *Klebsiella pneumoniae* | 59,714 | Nov. 4, 1998 |
|  |  | GB_BA2:NGOCPSPS | 8905 L09189 | *Neisseria meningitidis* dTDP-D-glucose 4,6-dehydratase (rfbB), glucose-1-phosphate thymidyl transferase (rfbA) and rfbC genes, complete cds and UPD-glucose-4-epimerase (galE) pseudogene. | *Neisseria meningitidis* | 58,384 | Jul. 30, 1996 |
| rxa01571 | 723 | GB_BA1:AB011413 | AB011413 | *Streptomyces griseus* genes for Orf2, Orf3, Orf4, Orf5, AfsA, Orf8, partial and complete cds. | *Streptomyces griseus* | 57,500 | Aug. 7, 1998 |
|  |  | GB_BA1:AB011413 | AB011413 | *Streptomyces griseus* genes for Orf2, Orf3, Orf4, Orf5, AfsA, Orf8, partial and complete cds. | *Streptomyces griseus* | 35,655 | Aug. 7, 1998 |
| rxa01572 | 615 | GB_BA1:AB011413 | AB011413 | *Streptomyces griseus* genes for Orf2, Orf3, Orf4, Orf5, AfsA, Orf8, partial and complete cds. | *Streptomyces griseus* | 57,843 | Aug. 7, 1998 |
|  |  | GB_BA1:AB011413 | AB011413 | *Streptomyces griseus* genes for Orf2, Orf3, Orf4, Orf5, AfsA, Orf8, partial and complete cds. | *Streptomyces griseus* | 38,199 | Aug. 7, 1998 |
| rxa01606 | 2799 | GB_VI:CFU72240 | U72240 | *Choristoneura fumiferana* nuclear polyhedrosis virus ETM protein homolog, 79 kDa protein homolog, 15 kDa protein homolog and GTA protein homolog genes, complete cds. | *Choristoneura fumiferana* nucleopolyhedrovirus | 37,115 | Jan. 29, 1999 |
|  |  | GB_GSS10:AQ213248 | 408 AQ213248 | HS_3249_B1_A02_MR CIT Approved Human Genomic Sperm Library D *Homo sapiens* genomic clone Plate = 3249 Col = 3 Row = B, genomic survey sequence. | *Homo sapiens* | 34,559 | Sep. 18, 1998 |
|  |  | GB_GSS8:AQ070145 | 285 AQ070145 | HS_3027_B1_H02_MR CIT Approved Human Genomic Sperm Library D *Homo sapiens* genomic clone Plate = 3027 Col = 3 Row = P, genomic survey sequence. | *Homo sapiens* | 40,351 | Aug. 5, 1998 |
| rxa01626 | 468 | GB_PR4:AF152510 | AF152510 | *Homo sapiens* protocadherin gamma A3 short form protein (PCDH-gamma-A3) variable region sequence, complete cds. | *Homo sapiens* | 34,298 | Jul. 14, 1999 |
|  |  | GB_PR4:AF152323 | AF152323 | *Homo sapiens* protocadherin gamma A3 (PCDH-gamma-A3) mRNA, complete cds. | *Homo sapiens* | 34,298 | Jul. 22, 1999 |
|  |  | GB_PR4:AF152509 | AF152509 | *Homo sapiens* PCDH-gamma-A3 gene, aberrantly spliced, mRNA sequence. | *Homo sapiens* | 34,298 | Jul. 14, 1999 |
| rxa01632 | 1128 | GB_HTG4:AC006590 | AC006590 | *Drosophila melanogaster* chromosome 2 clone BACR13N02 (D543) RPCI-98 13.N.2 map 36E-36E strain y; cn bw sp, **** SEQUENCING IN PROGRESS ****, 101 unordered pieces. | *Drosophila melanogaster* | 33,812 | Oct. 19, 1999 |
|  |  | GB_HTG4:AC006590 | 127171 AC006590 | *Drosophila melanogaster* chromosome 2 clone BACR13N02 (D543) RPCI-98 13.N.2 map 36E-36E strain y; cn bw sp, **** SEQUENCING IN PROGRESS ****, 101 unordered pieces. | *Drosophila melanogaster* | 33,812 | Oct. 19, 1999 |
|  |  | GB_GSS8:B99182 | 415 B99182 | CIT-HSP-2280I13.TR CIT-HSP *Homo sapiens* genomic clone 2280I13, genomic survey sequence. | *Homo sapiens* | 36,111 | Jun. 26, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01633 | 1206 | GB_BA1:BSUB0009 | 208780 | Z99112 | Bacillus subtilis complete genome (section 9 of 21): from 1598421 to 1807200. | Bacillus subtilis | 36,591 | Nov. 26, 1997 |
| | | GB_BA1:BSUB0009 | 208780 | Z99112 | Bacillus subtilis complete genome (section 9 of 21): from 1598421 to 1807200. | Bacillus subtilis | 34,941 | Nov. 26, 1997 |
| | | GB_HTG2:AC006247 | 174368 | AC006247 | Drosophila melanogaster chromosome 2 clone BACR48I10 (D505) RPCI-98 48.I.10 map 49E6-49F8 strain y; cn bw sp, *** SEQUENCING IN PROGRESS ***, 17 unordered pieces. | Drosophila melanogaster | 37,037 | Aug. 2, 1999 |
| rxa01695 | 1623 | GB_BA1:CGA224946 | 2408 | AJ224946 | Corynebacterium glutamicum DNA for L-Malate:quinone oxidoreductase. | Corynebacterium glutamicum | 100,000 | Aug. 11, 1998 |
| | | GB_BA1:MTCY24A1 | 20270 | Z95207 | Mycobacterium tuberculosis H37Rv complete genome; segment 124/162. | Mycobacterium tuberculosis | 38,626 | Jun. 17, 1998 |
| | | GB_IN1:DMU15974 | 2994 | U15974 | Drosophila melanogaster kinesin-like protein (klp68d) mRNA, complete cds. | Drosophila melanogaster | 36,783 | Jul. 18, 1995 |
| rxa01702 | 1155 | GB_BA1:CGFDA | 3371 | X17313 | Corynebacterium glutamicum fda gene for fructose-bisphosphate aldolase (EC 4.1.2.13). | Corynebacterium glutamicum | 99,913 | Sep. 12, 1993 |
| | | GB_BA1:MTY13E10 | 35019 | Z95324 | Mycobacterium tuberculosis H37Rv complete genome; segment 18/162. | Mycobacterium tuberculosis | 38,786 | Jun. 17, 1998 |
| | | GB_BA1:MLCB4 | 36310 | AL023514 | Mycobacterium leprae cosmid B4. | Mycobacterium leprae | 38,238 | Aug. 27, 1999 |
| rxa01743 | 901 | GB_IN2:CELC27H5 | 35840 | U14635 | Caenorhabditis elegans cosmid C27H5. | Caenorhabditis elegans | 35,334 | Jul. 13, 1995 |
| | | GB_EST24:AI167112 | 579 | AI167112 | xylem. est. 878 Poplar xylem Lambda ZAPII library Populus balsamifera subsp. trichocarpa cDNA 5', mRNA sequence. | Populus balsamifera subsp. | 39,222 | Dec, 3, 1998 |
| | | GB_GSS9:AQ102635 | 347 | AQ102635 | HS_3048_B1_F08_MF CIT Approved Human Genomic Sperm Library D Homo sapiens genomic clone Plate = 3048 Col = 15 Row = L, genomic survey sequence. | Homo sapiens | 40,653 | Aug. 27, 1998 |
| rxa01744 | 1662 | GB_BA1:MTCY01B2 | 35938 | Z95554 | Mycobacterium tuberculosis H37Rv complete genome; segment 72/162. | Mycobacterium tuberculosis | 36,650 | Jun. 17, 1998 |
| | | GB_GSS1:AF009226 | 665 | AF009226 | Mycobacterium tuberculosis cytochrome D oxidase subunit I (appC) gene, partial sequence, genomic survey sequence. | Mycobacterium tuberculosis | 63,438 | Jul. 31, 1997 |
| | | GB_BA1:SCD78 | 36224 | AL034355 | Streptomyces coelicolor cosmid D78. | Streptomyces coelicolor | 53,088 | Nov. 26, 1998 |
| rxa01745 | 836 | GB_BA1:MTCY190 | 34150 | Z70283 | Mycobacterium tuberculosis H37Rv complete genome; segment 98/162. | Mycobacterium tuberculosis | 62,081 | Jun. 17, 1998 |
| | | GB_BA1:MLCB22 | 40281 | Z98741 | Mycobacterium leprae cosmid B22. | Mycobacterium leprae | 61,364 | Aug. 22, 1997 |
| | | GB_BA2:AE000175 | 15067 | AE000175 | Escherichia coli K-12 MG1655 section 65 of 400 of the complete genome. | Escherichia coli | 52,323 | Nov. 12, 1998 |
| rxa01758 | 1140 | GB_PR3:HS57G9 | 113872 | Z95116 | Human DNA sequence from BAC 57G9 on chromosome 22q12.1 Contains ESTS, CA repeat, GSS. | Homo sapiens | 39,209 | Nov. 23, 1999 |
| | | GB_PL2:YSCH9666 | 39057 | U10397 | Saccharomyces cerevisiae chromosome VIII cosmid 9666. | Saccharomyces cerevisiae | 40,021 | Sep. 5, 1997 |
| | | GB_PL2:YSCH9986 | 41664 | U00027 | Saccharomyces cerevisiae chromosome VIII cosmid 9986. | Saccharomyces cerevisiae | 34,375 | Aug. 29, 1997 |
| rxa01814 | 1785 | GB_BA1:ABCCELB | 2058 | L24077 | Acetobacter xylinum phosphoglucomutase (celB) gene, complete cds. | Acetobacter xylinus | 62,173 | Sep. 21, 1994 |
| | | GB_BA1:MTCY22D7 | 31859 | Z83866 | Mycobacterium tuberculosis H37Rv complete genome; segment 133/162. | Mycobacterium tuberculosis | 39,749 | Jun. 17, 1998 |
| | | GB_BA1:MTCY22D7 | 31859 | Z83866 | Mycobacterium tuberculosis H37Rv complete genome; segment 133/162. | Mycobacterium tuberculosis | 40,034 | Jun. 17, 1998 |
| rxa01851 | 1809 | GB_GSS9:A0142579 | 529 | AQ142579 | HS_2222_B1_H03_MR CIT Approved Human Genomic Sperm Library D Homo sapiens genomic clone Plate = 2222 Col = 5 Row = P, genomic survey sequence. | Homo sapiens | 38,068 | Sep. 24, 1998 |
| | | GB_IN2:AC005889 | 108924 | AC005889 | Drosophila melanogaster, chromosome 2L, region 30A3- 30A6, P1 clones DS06958 and DS03097, complete sequence. | Drosophila melanogaster | 36,557 | Oct. 30, 1998 |
| | | GB_GSS1:AG008814 | 637 | AG008814 | Homo sapiens genomic DNA, 21q region, clone: B137B7BB68, genomic survey sequence. | Homo sapiens | 35,316 | Feb. 7, 1999 |
| rxa01859 | 1050 | GB_BA2:AF183408 | 63626 | AF183408 | Microcystis aeruginosa DNA polymerase III beta subunit (dnaN) gene, partial cds; microcystin synthetase gene cluster, complete sequence; Uma1 (uma1), Uma2 (uma2), Uma3 (uma3), Uma4 (uma4), and Uma5 (uma5) genes, complete cds; and Uma6 (uma6) gene, partial cds. | Microcystis aeruginosa | 36,364 | Oct. 3, 1999 |
| | | GB_HTG5:AC008031 | 158889 | AC008031 | Trypanosoma brucei chromosome II clone RPCI93-25N14, *** SEQUENCING IN PROGRESS ***, 2 unordered pieces. | Trypanosoma brucei | 35,334 | Nov. 15, 1999 |
| | | GB_BA2:AF183408 | 63626 | AF183408 | Microcystis aeruginosa DNA polymerase III beta subunit (dnaN) gene, partial cds; microcystin synthetase gene cluster, complete sequence; Uma1 (uma1), Uma2 (uma2), Uma3 (uma3), Uma4 (uma4), and Uma5 (uma5) genes, complete cds; and Uma6 (uma6) gene, partial cds. | Microcystis aeruginosa | 36,529 | Oct. 3, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01865 | 438 | GB_BA1:SERFDXA | 3869 | M61119 | *Saccharopolyspora erythraea* ferredoxin (fdxA) gene, complete cds. | *Saccharopolyspora erythraea* | 59,862 | Mar. 13, 1996 |
| | | GB_BA1:MTV005 | 37840 | AL010186 | *Mycobacterium tuberculosis* H37Rv complete genome; segment 51/162. | *Mycobacterium tuberculosis* | 61,949 | Jun. 17, 1998 |
| | | GB_BA1:MSGY348 | 40056 | AD000020 | *Mycobacterium tuberculosis* sequence from clone y348. | *Mycobacterium tuberculosis* | 59,908 | Dec. 10, 1996 |
| rxa01882 | 1113 | GB_PR1:HUMADRA2C | 1491 | J03853 | Human kidney alpha-2-adrenergic receptor mRNA, complete cds. | *Homo sapiens* | 36,899 | Apr. 27, 1993 |
| | | GB_PR4:HSU72648 | 4850 | U72648 | *Homo sapiens* alpha2-C4-adrenergic receptor gene, complete cds. | *Homo sapiens* | 36,899 | Nov. 23, 1998 |
| | | GB_GSS3:B42200 | 387 | B42200 | HS-1055-B1-A03-MR.abi CIT Human Genomic Sperm Library C *Homo sapiens* genomic clone Plate = CT 777 Col = 5 Row = B, genomic survey sequence. | *Homo sapiens* | 34,805 | Oct. 18, 1997 |
| rxa01884 | 1913 | GB_BA1:MTCY48 | 35377 | Z74020 | *Mycobacterium tuberculosis* H37Rv complete genome; segment 69/162. | *Mycobacterium tuberculosis* | 37,892 | Jun. 17, 1998 |
| | | GB_BA1:SCO001206 | 9184 | AJ001206 | *Streptomyces coelicolor* A3(2), glycogen metabolism cluster II. | *Streptomyces coelicolor* | 40,413 | Mar. 29, 1999 |
| | | GB_BA1:D90908 | 122349 | D90908 | *Synechocystis* sp. PCC6803 complete genome, 10/27, 1188886-1311234. | *Synechocystis* sp. | 47,792 | Feb. 7, 1999 |
| rxa01886 | 897 | GB_GSS9:AQ116291 | 572 | AQ116291 | RPCI11-49P6.TK.1 RPCI-11 *Homo sapiens* genomic clone RPCI-11-49P6, genomic survey sequence. | *Homo sapiens* | 43,231 | Apr. 20, 1999 |
| | | GB_BA2:AE001721 | 17632 | AE001721 | *Thermotoga maritima* section 33 of 136 of the complete genome. | *Thermotoga maritima* | 39,306 | Jun. 2, 1999 |
| | | GB_EST16:AA567090 | 596 | AA567090 | GM01044.5prime GM *Drosophila melanogaster* ovary BlueScript *Drosophila melanogaster* cDNA clone GM01044 5prime, mRNA sequence. | *Drosophila melanogaster* | 42,807 | Nov. 28, 1998 |
| rxa01887 | 1134 | GB_HTG6:AC008147 | 303147 | AC008147 | *Homo sapiens* clone RP3-405J10, *** SEQUENCING IN PROGRESS ***, 102 unordered pieces. | *Homo sapiens* | 36,417 | Dec. 3, 1999 |
| | | GB_HTG6:AC008147 | 303147 | AC008147 | *Homo sapiens* clone RP3-405J10, *** SEQUENCING IN PROGRESS ***, 102 unordered pieces. | *Homo sapiens* | 37,667 | Dec. 3, 1999 |
| | | GB_BA2:ALW243431 | 26953 | AJ243431 | *Acinetobacter lwoffii* wzc, wzb, wza, weeA, weeB, weeC, wzx, wzy, weeD, weeE, weeF, weeG, weeH, weeI, weeJ, weeK, galU, ugd, pgi, galE, pgm (partial) and mip (partial) genes (emulsan biosynthetic gene cluster), strain RAG-1. | *Acinetobacter lwoffii* | 39,640 | Oct. 1, 1999 |
| rxa01888 | 658 | GB_HTG2:AC008197 | 125235 | AC008197 | *Drosophila melanogaster* chromosome 3 clone BACR02L12 (D753) RPCI-98 02.L.12 map 94B-94C strain y; cn bw sp, **** SEQUENCING IN PROGRESS ***, 113 unordered pieces. | *Drosophila melanogaster* | 32,969 | Aug. 2, 1999 |
| | | GB_HTG2:AC008197 | 125235 | AC008197 | *Drosophila melanogaster* chromosome 3 clone BACR02L12 (D753) RPCI-98 02.L.12 map 94B-94C strain y; cn bw sp, **** SEQUENCING IN PROGRESS ***, 113 unordered pieces. | *Drosophila melanogaster* | 32,969 | Aug. 2, 1999 |
| | | GB_EST36:AI881527 | 598 | AI881527 | 606070C09.y1 606 - Ear tissue cDNA library from Schmidt lab *Zea mays* cDNA mRNA sequence. | *Zea mays* | 43,617 | Jul. 21, 1999 |
| rxa01891 | 887 | GB_VI:HIV232971 | 621 | AJ232971 | Human immunodeficiency virus type 1 subtype C nef gene, patient MP3. | Human immunodeficiency virus type 1 | 40,040 | Mar. 5, 1999 |
| | | GB_PL1:AFCHSE | 6158 | Y09542 | *A. fumigatus* chsE gene. | *Aspergillus fumigatus* | 37,844 | Apr. 1, 1997 |
| | | GB_PR3:AF064858 | 193387 | AF064858 | *Homo sapiens* chromosome 21q22.3 BAC 28F9, complete sequence. | *Homo sapiens* | 37,136 | Jun. 2, 1998 |
| rxa01895 | 1051 | GB_BA1:CGL238250 | 1593 | AJ238250 | *Corynebacterium glutamicum* ndh gene. | *Corynebacterium glutamicum* | 100,000 | Apr. 24, 1999 |
| | | GB_BA2:AF038423 | 1376 | AF038423 | *Mycobacterium smegmatis* NADH dehydrogenase (ndh) gene, complete cds. | *Mycobacterium smegmatis* | 65,254 | May 5, 1998 |
| | | GB_BA1:MTCY359 | 36021 | Z83859 | *Mycobacterium tuberculosis* H37Rv complete genome; segment 84/162. | *Mycobacterium tuberculosis* | 40,058 | Jun. 17, 1998 |
| rxa01901 | 1383 | GB_BA1:MSGB38COS | 37114 | L01095 | *M. leprae* genomic DNA sequence, cosmid B38 bfr gene, complete cds. | *Mycobacterium leprae* | 59,551 | Sep. 6, 1994 |
| | | GB_BA1:SC63 | 37200 | AL035640 | *Streptomyces coelicolor* cosmid E63. | *Streptomyces coelicolor* | 39,468 | Mar. 17, 1999 |
| | | GB_PR3:AF093117 | 147216 | AF093117 | *Homo sapiens* chromosome 7qtelo BAC E3, complete sequence. | *Homo sapiens* | 39,291 | Oct. 2, 1998 |
| rxa01927 | 1503 | GB_BA1:CGPAN | 2164 | X96580 | *C. glutamicum* panB, panC & xylB genes. | *Corynebacterium glutamicum* | 38,384 | May 11, 1999 |
| | | GB_BA1:ASXYLA | 1905 | X59466 | *Arthrobacter* Sp. N.R.R.L. B3728 xylA gene for D-xylose(D-glucose) isomerase | *Arthrobacter* sp. | 56,283 | May 4, 1992 |
| | | GB_HTG3:AC009500 | 176060 | AC009500 | *Homo sapiens* clone NH0511A20, *** SEQUENCING IN PROGRESS ***, 6 unordered pieces. | *Homo sapiens* | 37,593 | Aug. 24, 1999 |

TABLE 4-continued

ALIGNMENT RESULTS

| ID # | length (NT) | Genbank Hit | Length Accession | Name of Genbank Hit | Source of Genbank Hit | % homology (GAP) | Date of Deposit |
|---|---|---|---|---|---|---|---|
| rxa01952 | 1836 | GB_BA2:AE000739 | 13335 AE000739 | *Aquifex aeolicus* section 71 of 109 of the complete genome. | *Aquifex aeolicus* | 36,309 | Mar. 25, 1998 |
| | | GB_EST28:AI519629 | 612 AI519629 | LD39282.5prime LD *Drosophila melanogaster* embryo pOT2 *Drosophila melanogaster* cDNA clone LD39282 5prime, mRNA sequence. | *Drosophila melanogaster* | 41,941 | Mar. 16, 1999 |
| | | GB_EST21:AA949396 | 767 AA949396 | LD28277.5prime LD *Drosophila melanogaster* embryo pOT2 *Drosophila melanogaster* cDNA clone LD28277 5prime, mRNA sequence. | *Drosophila melanogaster* | 39,855 | Nov. 25, 1998 |
| rxa01989 | 630 | GB_BA1:BSPGIA | 1822 X16639 | *Bacillus stearothermophilus* pgiA gene for phosphoglucoisomerase isoenzyme A (EC 5.3.1.9). | *Bacillus stearothermophilus* | 66,292 | Apr. 20, 1995 |
| | | GB_BA1:BSUB0017 | 217420 Z99120 | *Bacillus subtilis* complete genome (section 17 of 21): from 3197001 to 3414420. | *Bacillus subtilis* | 37,255 | Nov. 26, 1997 |
| | | GB_BA2:AF132127 | 8452 AF132127 | *Streptococcus mutans* sorbitol phosphoenolpyruvate:sugar phosphotransferase operon, complete sequence and unknown gene. | *Streptococcus mutans* | 63,607 | Sep. 28, 1999 |
| rxa02026 | 720 | GB_BA1:SXSCRBA | 3161 X67744 | *S. xylosus* scrB and scrR genes. | *Staphylococcus xylosus* | 67,778 | Nov. 28, 1996 |
| | | GB_BA1:BSUB0020 | 212150 Z99123 | *Bacillus subtilis* complete genome (section 20 of 21): from 3798401 to 4010550. | *Bacillus subtilis* | 35,574 | Nov. 26, 1997 |
| | | GB_BA1:BSGENR | 97015 X73124 | B. subtilis genomic region (325 to 333). | *Bacillus subtilis* | 51,826 | Nov. 2, 1993 |
| rxa02028 | 526 | GB_BA1:MTCI237 | 27030 Z94752 | *Mycobacterium tuberculosis* H37Rv complete genome; segment 46/162. | *Mycobacterium tuberculosis* | 54,476 | Jun. 17, 1998 |
| | | GB_PL2:SCE9537 | 66030 U18778 | *Saccharomyces cerevisiae* chromosome V cosmids 9537, 9581, 9495, 9867, and lambda clone 5898. | *Saccharomyces cerevisiae* | 36,100 | Aug. 1, 1997 |
| | | GB_GSS13:AQ501177 | 767 AQ501177 | V26G9 mTn-3xHA/lacZ Insertion Library *Saccharomyces cerevisiae* genomic 5', genomic survey sequence. | *Saccharomyces cerevisiae* | 32,039 | Apr. 29, 1999 |
| rxa02054 | 1140 | GB_BA1:MLCB1222 | 34714 AL049491 | *Mycobacterium leprae* cosmid B1222. | *Mycobacterium leprae* | 61,896 | Aug. 27, 1999 |
| | | GB_BA1:MTY13E12 | 43401 Z95390 | *Mycobacterium tuberculosis* H37Rv complete genome; segment 147/162. | *Mycobacterium tuberculosis* | 59,964 | Jun. 17, 1998 |
| | | GB_BA1:MTU43540 | 3453 U43540 | *Mycobacterium tuberculosis* rfbA, rhamnose biosynthesis protein (rfbA), and mlC genes, complete cds. | *Mycobacterium tuberculosis* | 59,659 | Aug. 14, 1997 |
| rxa02056 | 2891 | GB_PAT:E14601 | 4394 E14601 | *Brevibacterium lactofermentum* gene for alpha-ketoglutaric acid dehydrogenase. | *Corynebacterium glutamicum* | 98,928 | Jul. 28, 1999 |
| | | GB_BA1:D84102 | 4394 D84102 | *Corynebacterium glutamicum* DNA for 2-oxoglutarate dehydrogenase, complete cds. | *Corynebacterium glutamicum* | 98,928 | Feb. 6, 1999 |
| | | GB_BA1:MTV006 | 22440 AL021006 | *Mycobacterium tuberculosis* H37Rv complete genome; segment 54/162. | *Mycobacterium tuberculosis* | 39,265 | Jun. 18, 1998 |
| rxa02061 | 1617 | GB_HTG7:AC005883 | 211682 AC005883 | *Homo sapiens* chromosome 17 clone RP11-958E11 map 17, *** SEQUENCING IN PROGRESS ***, 2 ordered pieces. | *Homo sapiens* | 37,453 | Dec. 8, 1999 |
| | | GB_PL2:ATAC003033 | 84254 AC003033 | *Arabidopsis thaliana* chromosome II BAC T21L14 genomic sequence, complete sequence. | *Arabidopsis thaliana* | 37,711 | Dec. 19, 1997 |
| | | GB_PL2:ATAC002334 | 75050 AC002334 | *Arabidopsis thaliana* chromosome II BAC F25I18 genomic sequence, complete sequence. | *Arabidopsis thaliana* | 37,711 | Mar. 4, 1998 |
| rxa02063 | 1350 | GB_BA1:SCGLGC | 1518 X89733 | *S. coelicolor* DNA for glgo gene. | *Streptomyces coelicolor* | 56,972 | Jul. 12, 1999 |
| | | GB_GSS4:AQ687350 | 786 AQ687350 | nbxb0074H11r CUGI Rice BAC Library *Oryza sativa* genomic clone nbxb0074H11r, genomic survey sequence. | *Oryza sativa* | 40,696 | Jul. 1, 1999 |
| | | GB_EST38:AW028530 | 444 AW028530 | wv27f10.x1 NCI_CGAP_Kid11 *Homo sapiens* cDNA clone IMAGE:2530795 3' similar to WP:T03G11.6 CE04874:, mRNA sequence. | *Homo sapiens* | 36,795 | Oct. 27, 1999 |
| nca02100 | 2348 | GB_BA1:MSGY151 | 37036 AD000018 | *Mycobacterium tuberculosis* sequence from clone y151. | *Mycobacterium tuberculosis* | 40,156 | Dec. 10, 1996 |
| | | GB_BA1:MTCY130 | 32514 Z73902 | *Mycobacterium tuberculosis* H37Rv complete genome; segment 59/162. | *Mycobacterium tuberculosis* | 55,218 | Jun. 17, 1998 |
| | | GB_BA1:SCOO1205 | 9589 AJ001205 | *Streptomyces coelicolor* A3(2) glycogen metabolism clusterl. | *Streptomyces coelicolor* | 38,475 | Mar. 29, 1999 |
| rxa02122 | 822 | GB_BA1:D90858 | 13548 D90858 | *E. coli* genomic DNA, Kohara clone #401(51.3-51.6 min.). | *Escherichia coli* | 38,586 | May 29, 1997 |
| | | GB_EST37:AI948595 | 469 AI948595 | wq07d12.x1 NCI_CGAP_Kid12 *Homo sapiens* cDNA clone IMAGE:2470583 3', mRNA sequence. | *Homo sapiens* | 37,259 | Sep. 6, 1999 |
| | | GB_HTG3:AC010387 | 220665 AC010387 | *Homo sapiens* chromosome 5 clone CITB-H1_2074D8, *** SEQUENCING IN PROGRESS ***, 77 unordered pieces. | *Homo sapiens* | 38,868 | Sep. 15, 1999 |
| rxa02140 | 1200 | GB_BA1:MSGB1551CS | 36548 L78813 | *Mycobacterium leprae* cosmid B1551 DNA sequence. | *Mycobacterium leprae* | 51,399 | Jun. 15, 1996 |
| | | GB_BA1:MSGB1554CS | 36548 L78814 | *Mycobacterium leprae* cosmid B1554 DNA sequence. | *Mycobacterium leprae* | 51,399 | Jun. 15, 1996 |
| | | GB_RO:AF093099 | 2482 AF093099 | *Mus musculus* transcription factor TBLYM (Tblym) mRNA, complete cds. | *Mus musculus* | 36,683 | Oct. 1, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02142 | 774 | GB_BA1:MTCY190 | 34150 | Z70283 | *Mycobacterium tuberculosis* H37Rv complete genome; segment 98/162. | *Mycobacterium tuberculosis* | 57,292 | Jun. 17, 1998 |
| | | GB_BA1:SC6G10 | 36734 | AL049497 | *Streptomyces coelicolor* cosmid 6G10. | *Streptomyces coelicolor* | 35,058 | Mar. 24, 1999 |
| | | GB_BA1:AB016787 | 5550 | AB016787 | *Pseudomonas putida* genes for cytochrome o ubiquinol oxidase A-E and 2 ORFs, complete cds. | *Pseudomonas putida* | 47,403 | Aug. 5, 1999 |
| rxa02143 | 1011 | GB_BA1:MTCY190 | 34150 | Z70283 | *Mycobacterium tuberculosis* H37Rv complete genome; segment 98/162. | *Mycobacterium tuberculosis* | 57,317 | Jun. 17, 1998 |
| | | GB_BA1:MSGB1551CS | 36548 | L78813 | *Mycobacterium leprae* cosmid B1551 DNA sequence. | *Mycobacterium leprae* | 38,159 | Jun. 15, 1996 |
| | | GB_BA1:MSGB1554CS | 36548 | L78814 | *Mycobacterium leprae* cosmid B1554 DNA sequence. | *Mycobacterium leprae* | 38,159 | Jun. 15, 1996 |
| rxa02144 | 1347 | GB_BA1:MTCY190 | 34150 | Z70283 | *Mycobacterium tuberculosis* H37Rv complete genome; segment 98/162. | *Mycobacterium tuberculosis* | 55,530 | Jun. 17, 1998 |
| | | GB_HTG3:AC011500_0 | 300851 | AC011500 | *Homo sapiens* chromosome 19 clone CIT978SKB_60E11, *** SEQUENCING IN PROGRESS ***, 246 unordered pieces. | *Homo sapiens* | 39,659 | Feb. 18, 2000 |
| | | GB_HTG3:AC011500_0 | 300851 | AC011500 | *Homo sapiens* chromosome 19 clone CIT978SKB_60E11, *** SEQUENCING IN PROGRESS ***, 246 unordered pieces. | *Homo sapiens* | 39,659 | Feb. 18, 2000 |
| rxa02147 | 1140 | GB_EST28:AI492095 | 485 | AI492095 | tg07a01.x1 NCI_CGAP_CLL1 *Homo sapiens* cDNA clone IMAGE:2108040 3′, mRNA sequence. | *Homo sapiens* | 39,798 | Mar. 30, 1999 |
| | | GB_EST10:AA157467 | 376 | AA157467 | zo50e01.r1 Stratagene endothelial cell 937223 *Homo sapiens* cDNA clone IMAGE:590328 5′; mRNA sequence. | *Homo sapiens* | 36,436 | Dec. 11, 1996 |
| | | GB_EST10:AA157467 | 376 | AA157467 | zo50e01.r1 Stratagene endothelial cell 937223 *Homo sapiens* cDNA clone IMAGE:590328 5′; mRNA sequence. | *Homo sapiens* | 36,436 | Dec. 11, 1996 |
| rxa02149 | 1092 | GB_PR3:HSBK277P6 | 61698 | AL117347 | Human DNA sequence from clone 277P6 on chromosome 1q25.3-31.2, complete sequence. | *Homo sapiens* | 36,872 | Nov. 23, 1999 |
| | | GB_BA2:EMB065R075 | 360 | AF116423 | *Rhizobium etli* mutant MB045 RosR-transcriptionally regulated sequence. | *Rhizobium etli* | 43,175 | Dec. 6, 1999 |
| | | GB_EST34:AI789323 | 574 | AI789323 | uk53g05.y1 Sugano mouse kidney mkia *Mus musculus* cDNA clone IMAGE:1972760 5′ similar to WP:K11H12.8 CE12160; mRNA sequence. | *Mus musculus* | 39,715 | Jul. 2, 1999 |
| rxa02175 | 1416 | GB_BA1:CGGLTG | 3013 | X66112 | *C. glutamicum* glt gene for citrate synthase and ORF. | *Corynebacterium glutamicum* | 100,000 | Feb. 17, 1995 |
| | | GB_BA1:MTCY31 | 37630 | Z73101 | *Mycobacterium tuberculosis* H37Rv complete genome; segment 41/162. | *Mycobacterium tuberculosis* | 64,331 | Jun. 17, 1998 |
| | | GB_BA1:MLCB57 | 38029 | Z99494 | *Mycobacterium leprae* cosmid B57. | *Mycobacterium leprae* | 62,491 | Feb. 10, 1999 |
| rxa02196 | 816 | GB_RO:RATDAPRP | 2819 | M76426 | *Rattus norvegicus* dipeptidyl aminopeptidase-related protein (dpp6) mRNA, complete cds. | *Rattus norvegicus* | 38,791 | May 31, 1995 |
| | | GB_GSS8:AO012162 | 763 | AQ012162 | 127PB037070197 Cosmid library of chromosome II *Rhodobacter sphaeroides* genomic clone 127PB037070197, genomic survey sequence. | *Rhodobacter sphaeroides* | 40,044 | Jun. 4, 1998 |
| | | GB_RO:RATDAPRP | 2819 | M76426 | *Rattus norvegicus* dipeptidyl aminopeptidase-related protein (dpp6) mRNA, complete cds. | *Rattus norvegicus* | 37,312 | May 31, 1995 |
| rxa02209 | 1694 | GB_BA1:AB025424 | 2995 | AB025424 | *Corynebacterium glutamicum* glt gene for aconitase, partial cds. | *Corynebacterium glutamicum* | 99,173 | Apr. 3, 1999 |
| | | GB_BA2:AF002133 | 15437 | AF002133 | *Mycobacterium avium* strain GIR10 transcriptional regulator (may81) gene, partial cds, aconitase (acn), invasin 1 (inv1), invasin 2 (inv2), transcriptional regulator (moxR), ketoacyl-reductase (fabG), enoyl-reductase (inhA) and ferrochelatase (mav272) genes, complete cds. | *Mycobacterium avium* | 40,219 | Mar. 26, 1998 |
| rxa02213 | 874 | GB_BA1:MTV007 | 32806 | AL021184 | *Mycobacterium tuberculosis* H37Rv complete genome; segment 64/162. | *Mycobacterium tuberculosis* | 38,253 | Jun. 17, 1998 |
| | | GB_BA1:AB025424 | 2995 | AB025424 | *Corynebacterium glutamicum* glt gene for aconitase, partial cds. | *Corynebacterium glutamicum* | 99,096 | Apr. 3, 1999 |
| | | GB_BA1:MTV007 | 32806 | AL021184 | *Mycobacterium tuberculosis* H37Rv complete genome; segment 64/162. | *Mycobacterium tuberculosis* | 34,937 | Jun. 17, 1998 |
| | | GB_BA2:AF002133 | 15437 | AF002133 | *Mycobacterium avium* strain GIR10 transcriptional regulator (may81) gene, partial cds, aconitase (acn), invasin 1 (inv1), invasin 2 (inv2), transcriptional regulator (moxR), ketoacyl-reductase (fabG), enoyl-reductase (inhA) and ferrochelatase (mav272) genes, complete cds. | *Mycobacterium avium* | 36,885 | Mar. 26, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02245 | 780 | GB_BA2:RCU23145 | 5960 | U23145 | *Rhodobacter capsulatus* Calvin cycle carbon dioxide fixation operon: fructose-1,6-/sedoheptulose-1,7-bisphosphate aldolase (cbbA) gene, partial cds, Form II ribulose-1,5-bisphosphate carboxylase/oxygenase (cbbM) gene, complete cds, and Calvin cycle operon: pentose-5-phosphate-3-epimerase (cbbE), phosphoglycolate phosphatase (cbbZ), and cbbY genes, complete cds. | *Rhodobacter capsulatus* | 48,701 | Oct. 28, 1997 |
|  |  | GB_BA1:ECU82664 | 139818 | U82664 | *Escherichia coli* minutes 9 to 11 genomic sequence. | *Escherichia coli* | 39,119 | Jan. 11, 1997 |
|  |  | GB_HTG2:AC007922 | 158858 | AC007922 | *Homo sapiens* chromosome 18 clone hRPK.178_F_10 map 18, *** SEQUENCING IN PROGRESS ***, 11 unordered pieces. | *Homo sapiens* | 33,118 | Jun. 26, 1999 |
| rxa02256 | 1125 | GB_BA1:CGGAPPGK | 3804 | X59403 | *C. glutamicum* gap, pgk and tpi genes for glyceraldehyde-3-phosphate, phosphoglycerate kinase and triosephosphate isomerase. | *Corynebacterium glutamicum* | 99,289 | Oct. 5, 1992 |
|  |  | GB_BA1:SCC54 | 30753 | AL035591 | *Streptomyces coelicolor* cosmid C54. | *Streptomyces coelicolor* | 36,951 | Jun. 11, 1999 |
|  |  | GB_BA1:MTCY493 | 40790 | Z95844 | *Mycobacterium tuberculosis* H37Rv complete genome; segment 63/162. | *Mycobacterium tuberculosis* | 64,196 | Jun. 19, 1998 |
| rxa02257 | 1338 | GB_BA1:CGGAPPGK | 3804 | X59403 | *C. glutamicum* gap, pgk and tpi genes for glyceraldehyde-3-phosphate, phosphoglycerate kinase and triosephosphate isomerase. | *Corynebacterium glutamicum* | 98,873 | Oct. 5, 1992 |
|  |  | GB_BA1:MTCY493 | 40790 | Z95844 | *Mycobacterium tuberculosis* H37Rv complete genome; segment 63/162. | *Mycobacterium tuberculosis* | 61,273 | Jun. 19, 1998 |
|  |  | GB_BA2:MAU82749 | 2530 | U82749 | *Mycobacterium avium* glyceraldehyde-3-phosphate dehydrogenase homolog (gapdh) gene, complete cds; and phosphoglycerate kinase gene, partial cds. | *Mycobacterium avium* | 61,772 | Jan. 6, 1998 |
| rxa02258 | 900 | GB_BA1:CGGAPPGK | 3804 | X59403 | *C. glutamicum* gap, pgk and tpi genes for glyceraldehyde-3-phosphate, phosphoglycerate kinase and triosephosphate isomerase. | *Corynebacterium glutamicum* | 99,667 | Oct. 5, 1992 |
|  |  | GB_BA1:CORPEPC | 4885 | M25819 | *C. glutamicum* phosphoenolpyruvate carboxylase gene, complete cds. | *Corynebacterium glutamicum* | 100,000 | Dec. 15, 1995 |
|  |  | GB_PAT:A09073 | 4885 | A09073 | *C. glutamicum* ppg gene for phosphoenol pyruvate carboxylase. | *Corynebacterium glutamicum* | 100,000 | Aug. 25, 1993 |
| rxa02259 | 2895 | GB_BA1:CORPEPC | 4885 | M25819 | *C. glutamicum* phosphoenolpyruvate carboxylase gene, complete cds. | *Corynebacterium glutamicum* | 100,000 | Dec. 15, 1995 |
|  |  | GB_PAT:A09073 | 4885 | A09073 | *C. glutamicum* ppg gene for phosphoenol pyruvate carboxylase. | *Corynebacterium glutamicum* | 100,000 | Aug. 25, 1993 |
|  |  | GB_BA1:CGPPC | 3292 | X14234 | *Corynebacterium glutamicum* phosphoenolpyruvate carboxylase gene (EC 4.1.1.31). | *Corynebacterium glutamicum* | 99,827 | Sep. 12, 1993 |
| rxa02288 | 969 | GB_PR3:HSDJ94E24 | 243145 | AL050317 | Human DNA sequence from clone RP1-94E24 on chromosome 20q12, complete sequence. | *Homo sapiens* | 36,039 | Dec. 3, 1999 |
|  |  | GB_HTG3:AC010091 | 159526 | AC010091 | *Homo sapiens* clone NH0295A01, *** SEQUENCING IN PROGRESS ***, 4 unordered pieces. | *Homo sapiens* | 35,331 | Sep. 11, 1999 |
|  |  | GB_HTG3:AC010091 | 159526 | AC010091 | *Homo sapiens* clone NH0295A01, *** SEQUENCING IN PROGRESS ***, 4 unordered pieces. | *Homo sapiens* | 35,331 | Sep. 11, 1999 |
| rxa02292 | 798 | GB_BA2:AF125164 | 26443 | AF125164 | *Bacteroides fragilis* 638R polysaccharide B (PS B2) biosynthesis locus, complete sequence; and unknown genes. | *Bacteroides fragilis* | 39,747 | Dec. 1, 1999 |
|  |  | GB_GSS5:AQ744695 | 827 | AQ744695 | HS_5505_A2_C06_SP6 RPCI-11 Human Male BAC Library *Homo sapiens* genomic clone Plate = 1081 Col = 12 Row = E, genomic survey sequence. | *Homo sapiens* | 39,185 | Jul. 16, 1999 |
|  |  | GB_EST14:AA381925 | 309 | AA381925 | EST95058 Activated T-cells I *Homo sapiens* cDNA 5' end, mRNA sequence. | *Homo sapiens* | 35,922 | Apr. 21, 1997 |
| rxa02322 | 511 | GB_BA1:MTCY22G8 | 22550 | Z95585 | *Mycobacterium tuberculosis* H37Rv complete genome; segment 49/162. | *Mycobacterium tuberculosis* | 57,677 | Jun. 17, 1998 |
|  |  | GB_BA1:MTCY22G8 | 22550 | Z95585 | *Mycobacterium tuberculosis* H37Rv complete genome; segment 49/162. | *Mycobacterium tuberculosis* | 37,143 | Jun. 17, 1998 |
| rxa02326 | 939 | GB_BA1:CGPYC | 3728 | Y09548 | *Corynebacterium glutamicum* pyc gene. | *Corynebacterium glutamicum* | 100,000 | May 8, 1998 |
|  |  | GB_BA2:AF038548 | 3637 | AF038548 | *Corynebacterium glutamicum* pyruvate carboxylase (pyc) gene, complete cds. | *Corynebacterium glutamicum* | 100,000 | Dec. 24, 1997 |
|  |  | GB_BA1:MTCY349 | 43523 | Z83018 | *Mycobacterium tuberculosis* H37Rv complete genome; segment 131/162. | *Mycobacterium tuberculosis* | 37,363 | Jun. 17, 1998 |
| rxa02327 | 1083 | GB_BA1:CGPYC | 3728 | Y09548 | *Corynebacterium glutamicum* pyc gene. | *Corynebacterium glutamicum* | 99,259 | May 8, 1998 |
|  |  | GB_BA2:AF038548 | 3637 | AF038548 | *Corynebacterium glutamicum* pyruvate carboxylase (pyc) gene, complete cds. | *Corynebacterium glutamicum* | 99,259 | Dec. 24, 1997 |
|  |  | GB_BA1:MTCY349 | 43523 | Z83018 | *Mycobacterium tuberculosis* H37Rv complete genome; segment 131/162. | *Mycobacterium tuberculosis* | 41,317 | Jun. 17, 1998 |
| rxa02328 | 1719 | GB_BA1:CGPYC | 3728 | Y09548 | *Corynebacterium glutamicum* pyc gene. | *Corynebacterium glutamicum* | 100,000 | May 8, 1998 |
|  |  | GB_BA2:AF038548 | 3637 | AF038548 | *Corynebacterium glutamicum* pyruvate carboxylase (pyc) gene, complete cds. | *Corynebacterium glutamicum* | 100,000 | Dec. 24, 1997 |
|  |  | GB_PL2:AF097728 | 3916 | AF097728 | *Aspergillus terreus* pyruvate carboxylase (Pyc) mRNA, complete cds. | *Aspergillus terreus* | 52,248 | Oct. 29, 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02332 | 1266 | GB_BA1:MSGLTA | 1776 | X60513 | M. smegmatis gltA gene for citrate synthetase. | Mycobacterium smegmatis | 58.460 | Sep. 20, 1991 |
|  |  | GB_BA2:ABU85944 | 1334 | U85944 | Antarctic bacterium DS2-3R citrate synthase (cisy) gene, complete cds. | Antarctic bacterium DS2-3R | 57.154 | Sep. 23, 1997 |
|  |  | GB_BA2:AE000175 | 15067 | AE000175 | Escherichia coli K-12 MG1655 section 65 of 400 of the complete genome. | Escherichia coli | 38.164 | Nov. 12, 1998 |
| rxa02333 | 1038 | GB_BA1:MSGLTA | 1776 | X60513 | M. smegmatis gltA gene for citrate synthetase. | Mycobacterium smegmatis | 58.929 | Sep. 20, 1991 |
|  |  | GB_PR4:HU:AC002299 | 171681 | AC002299 | Homo sapiens Chromosome 16 BAC clone CIT987-SKA-113A6 -complete genomic sequence, complete sequence. | Homo sapiens | 33.070 | Nov. 23, 1999 |
|  |  | GB_HTG2:AC007889 | 127840 | AC007889 | Drosophila melanogaster chromosome 3 clone BACR48E12 (D695) RPCI-98 48.E.12 map 87A-87B strain y; cn bw sp, *** SEQUENCING IN PROGRESS ***, 86 unordered pieces. | Drosophila melanogaster | 34.897 | Aug. 2, 1999 |
| rxa02399 | 1467 | GB_BA1:CGACEA | 2427 | X75504 | C. glutamicum aceA gene and thiX genes (partial). | Corynebacterium glutamicum | 100.000 | Sep. 9, 1994 |
|  |  | GB_BA1:CORACEA | 1905 | L28760 | Corynebacterium glutamicum isocitrate lyase (aceA) gene. | Corynebacterium glutamicum | 100.000 | Feb. 10, 1995 |
|  |  | GB_PAT:I13693 | 2135 | I13693 | Sequence 3 from U.S. Pat. No. 5439822. | Unknown. | 99.795 | Sep. 26, 1995 |
| rxa02404 | 2340 | GB_BA1:CGACEB | 3024 | X78491 | C. glutamicum (ATCC 13032) aceB gene. | Corynebacterium glutamicum | 99.914 | Jan. 13, 1995 |
|  |  | GB_BA1:CORACEB | 2725 | L27123 | Corynebacterium glutamicum malate synthase (aceB) gene, complete cds. | Corynebacterium glutamicum | 99.786 | Jun. 8, 1995 |
|  |  | GB_BA1:PFFC2 | 5588 | Y11996 | P. fluorescens FC2.1, FC2.2, FC2.3c, FC2.4 and FC2.5c open reading frames. | Pseudomonas fluorescens | 63.539 | Jul. 11, 1997 |
| rxa02414 | 870 | GB_PR4:AC007102 | 176258 | AC007102 | Homo sapiens chromosome 4 clone C0162P16 map 4p16, complete sequence. | Homo sapiens | 35.069 | Jun. 2, 1999 |
|  |  | GB_HTG3:AC011214 | 183414 | AC011214 | Homo sapiens clone 5_C_3, LOW-PASS SEQUENCE SAMPLING. | Homo sapiens | 36.885 | Oct. 3, 1999 |
|  |  | GB_HTG3:AC011214 | 183414 | AC011214 | Homo sapiens clone 5_C_3, LOW-PASS SEQUENCE SAMPLING. | Homo sapiens | 36.885 | Oct. 3, 1999 |
| rxa02435 | 681 | GB_BA2:AF101055 | 7457 | AF101055 | Clostridium acetobutylicum atp operon, complete sequence. | Clostridium acetobutylicum | 39.605 | Mar. 3, 1999 |
|  |  | GB_OM:RABPKA | 4441 | J03247 | Rabbit phosphorylase kinase (alpha subunit) mRNA, complete cds. | Oryctolagus cuniculus | 36.061 | Apr. 27, 1993 |
|  |  | GB_OM:RABPLASISM | 4458 | M64656 | Oryctolagus cuniculus phosphorylase kinase alpha subunit mRNA, complete cds. | Oryctolagus cuniculus | 36.000 | Jun. 22, 1998 |
| rxa02440 | 963 | GB_EST14:AA417723 | 374 | AA417723 | zv01b12.s1 NCL_CGAP_GCB1 Homo sapiens cDNA clone IMAGE:746207 3' similar to contains Alu repetitive element; contains element L1 repetitive element; mRNA sequence. | Homo sapiens | 38.770 | Oct. 16, 1997 |
|  |  | GB_EST11:AA215428 | 303 | AA215428 | zr95a07.s1 NCL_CGAP_GCB1 Homo sapiens cDNA clone IMAGE:683412 3' similar to contains Alu repetitive element; mRNA sequence. | Homo sapiens | 39.934 | Aug. 13, 1997 |
| rxa02453 | 876 | GB_BA1:MTCY77 | 22255 | Z95389 | Mycobacterium tuberculosis H37Rv complete genome; segment 146/162. | Mycobacterium tuberculosis | 38.889 | Jun. 18, 1998 |
|  |  | GB_EST14:AA426336 | 375 | AA426336 | zv53g02.s1 Soares_testis_NHT Homo sapiens cDNA clone IMAGE:757394 3', mRNA sequence. | Homo sapiens | 38.043 | Oct. 16, 1997 |
| rxa02474 | 897 | GB_BA1:STMAACC8 | 1353 | M55426 | S. fradiae aminoglycoside acetyltransferase (aacC8) gene, complete cds. | Streptomyces fradiae | 37.097 | May 5, 1993 |
|  |  | GB_PR3:AC004500 | 77538 | AC004500 | Homo sapiens chromosome 5, P1 clone 1076B9 (LBNL H14), complete sequence. | Homo sapiens | 33.256 | Mar. 30, 1998 |
|  |  | GB_BA1:AB009078 | 2686 | AB009078 | Brevibacterium saccharolyticum gene for L-2,3-butanediol dehydrogenase, complete cds. | Brevibacterium saccharolyticum | 96.990 | Feb. 13, 1999 |
|  |  | GB_OM:BTU71200 | 877 | U71200 | Bos taurus acetoin reductase mRNA, complete cds. | Bos taurus | 51.659 | Oct. 8, 1997 |
|  |  | GB_EST2:F12685 | 287 | F12685 | HSC3DA031 normalized infant brain cDNA Homo sapiens cDNA clone c-3da03, mRNA sequence | Homo sapiens | 41.509 | Mar. 14, 1995 |
| rxa02480 | 1779 | GB_BA1:MTV012 | 70287 | AL021287 | Mycobacterium tuberculosis H37Rv complete genome; segment 132/162. | Mycobacterium tuberculosis | 36.737 | Jun. 23, 1999 |
|  |  | GB_BA1:SC6G10 | 36734 | AL049497 | Streptomyces coelicolor cosmid 6G10. | Streptomyces coelicolor | 35.511 | Mar. 24, 1999 |
|  |  | GB_BA1:AP000060 | 347800 | AP000060 | Aeropyrum pernix genomic DNA, section 3/7. | Aeropyrum pernix | 48.014 | Jun. 22, 1999 |
| rxa02485 |  |  |  |  |  |  |  |  |
| rxa02492 | 840 | GB_BA1:STMPGM | 921 | M83661 | Streptomyces coelicolor phosphoglycerate mutase (PGM) gene, complete cds. | Streptomyces coelicolor | 65.672 | Apr. 26, 1993 |
|  |  | GB_BA1:MTCY20G9 | 37218 | Z77162 | Mycobacterium tuberculosis H37Rv complete genome; segment 25/162. | Mycobacterium tuberculosis | 61.436 | Jun. 17, 1998 |
|  |  | GB_BA1:U00018 | 42991 | U00018 | Mycobacterium leprae cosmid B2168. | Mycobacterium leprae | 37.893 | Mar. 1, 1994 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02528 | 1098 | GB_PR2:HS161N10 | 56075 | AL008707 | Human DNA sequence from PAC 161N10 on chromosome Xq25. Contains EST. | Homo sapiens | 37,051 | Nov. 23, 1999 |
| | | GB_HTG2:AC008235 | 136017 | AC008235 | Drosophila melanogaster chromosome 3 clone BACR15B19 (D995) RPCI-98 15.B.19 map 94F-95A strain y; cn bw sp, *** SEQUENCING IN PROGRESS ***, 125 unordered pieces. | Drosophila melanogaster | 36,822 | Aug. 2, 1999 |
| | | GB_HTG2:AC008235 | 136017 | AC008235 | Drosophila melanogaster chromosome 3 clone BACR15B19 (D995) RPCI-98 15.B.19 map 94F-95A strain y; cn bw sp, *** SEQUENCING IN PROGRESS ***, 125 unordered pieces. | Drosophila melanogaster | 36,822 | Aug. 2, 1999 |
| rxa02539 | 1641 | GB_BA2:RSU17129 | 17425 | U17129 | Rhodococcus erythropolis ThcA (thcA) gene, complete cds; and unknown genes. | Rhodococcus erythropolis | 66,117 | Jul. 16, 1999 |
| | | GB_BA1:MTV038 | 16094 | AL021933 | Mycobacterium tuberculosis H37RV complete genome; segment 24/162. | Mycobacterium tuberculosis | 65,174 | Jun. 17, 1998 |
| | | GB_BA2:AF068264 | 3152 | AF068264 | Pseudomonas aeruginosa quinoprotein ethanol dehydrogenase (exaA)gene, partial cds; cytochrome c550 precursor (exaB), NAD+ dependent acetaldehyde dehydrogenase (exaC), and pyrroloquinoline quinone synthesis A (pqqA) genes, complete cds; and pyrroloquinoline quinone synthesis B (pqqB) gene, partial cds. | Pseudomonas aeruginosa | 65,448 | Mar. 18, 1999 |
| rxa02551 | 483 | GB_BA1:BACHYPTP | 17057 | D29985 | Bacillus subtilis wapA and orf genes for wall-associated protein and hypothetical proteins. | Bacillus subtilis | 53,602 | Feb. 7, 1999 |
| | | GB_BA1:BACHUTWAPA | 28954 | D31856 | Bacillus subtilis genome containing the hut and wapA loci. | Bacillus subtilis | 53,602 | Feb. 7, 1999 |
| | | GB_BA1:BSGBGLUC | 4290 | Z34526 | B. subtilis (Marburg 168) genes for beta-glucoside permease and beta-glucosidase. | Bacillus subtilis | 53,602 | Jul. 3, 1995 |
| rxa02556 | 1281 | GB_HTG3:AC008126 | 335761 | AC008126 | Homo sapiens, *** SEQUENCING IN PROGRESS ***, 106 unordered pieces. | Homo sapiens | 34,022 | Aug. 22, 1999 |
| | | GB_HTG3:AC008128 | 335761 | AC008128 | Homo sapiens, *** SEQUENCING IN PROGRESS ***, 106 unordered pieces. | Homo sapiens | 34,022 | Aug. 22, 1999 |
| | | GB_PL2:AC005292 | 99053 | AC005292 | Genomic sequence for Arabidopsis thaliana BAC F26F24, complete sequence. | Arabidopsis thaliana | 33,858 | Apr. 16, 1999 |
| rxa02560 | 990 | GB_IN1:CEF07A11 | 35692 | Z66511 | Caenorhabditis elegans cosmid F07A11, complete sequence. | Caenorhabditis elegans | 36,420 | Sep. 2, 1999 |
| | | GB_EST32:AI731605 | 566 | AI731605 | BNLGHi10201 Six-day Cotton fiber Gossypium hirsutum cDNA 5' similar to (AC004684) hypothetical protein [Arabidopsis thaliana], mRNA sequence. | Gossypium hirsutum | 38,095 | Jun. 11, 1999 |
| rxa02572 | 668 | GB_IN1:CEF07A11 | 35692 | Z66511 | Caenorhabditis elegans cosmid F07A11, complete sequence. | Caenorhabditis elegans | 33,707 | Sep. 2, 1999 |
| | | GB_BA1:MTCY63 | 38900 | Z96800 | Mycobacterium tuberculosis H37Rv complete genome; segment 16/162. | Mycobacterium tuberculosis | 61,677 | Jun. 17, 1998 |
| | | GB_BA1:MTCY63 | 38900 | Z96800 | Mycobacterium tuberculosis H37Rv complete genome; segment 16/162. | Mycobacterium tuberculosis | 37,170 | Jun. 17, 1998 |
| | | GB_HTG1:HS24H01 | 46989 | AL121632 | Homo sapiens chromosome 21 clone LLNLc116H0124 map 21q21, *** SEQUENCING IN PROGRESS ***, in unordered pieces. | Homo sapiens | 19,820 | Sep. 29, 1999 |
| rxa02596 | 1326 | GB_BA1:MTV026 | 23740 | AL022076 | Mycobacterium tuberculosis H37Rv complete genome; segment 157/162. | Mycobacterium tuberculosis | 36,957 | Jun. 24, 1999 |
| | | GB_BA2:AF026540 | 1778 | AF026540 | Mycobacterium tuberculosis UDP-galactopyranose mutase (glf) gene, complete cds. | Mycobacterium tuberculosis | 67,627 | Oct. 30, 1998 |
| | | GB_BA2:MTU96128 | 1200 | U96128 | Mycobacterium tuberculosis UDP-galactopyranose mutase (glf) gene, complete cds. | Mycobacterium tuberculosis | 70,417 | Mar. 25, 1998 |
| rxa02611 | 1775 | GB_BA1:MTCY130 | 32514 | Z73902 | Mycobacterium tuberculosis H37Rv complete genome; segment 59/162. | Mycobacterium tuberculosis | 38,532 | Jun. 17, 1998 |
| | | GB_BA1:MSGY151 | 37036 | AD000018 | Mycobacterium leprae cosmid sequence from clone y151. | Mycobacterium tuberculosis | 60,575 | Dec. 10, 1996 |
| | | GB_BA1:U00014 | 36470 | U00014 | Mycobacterium leprae cosmid B1549. | Mycobacterium leprae | 57,486 | Sep. 29, 1994 |
| rxa02612 | 2316 | GB_BA1:MTCY130 | 32514 | Z73902 | Mycobacterium tuberculosis H37Rv complete genome; segment 59/162. | Mycobacterium tuberculosis | 38,018 | Jun. 17, 1998 |
| | | GB_BA1:MSGY151 | 37036 | AD000018 | Mycobacterium leprae cosmid sequence from clone y151. | Mycobacterium tuberculosis | 58,510 | Dec. 10, 1996 |
| | | GB_BA1:STMGLGEN | 2557 | L11647 | Streptomyces aureofaciens glycogen branching enzyme (glgB) gene, complete cds. | Streptomyces aureofaciens | 57,193 | May 25, 1995 |
| rxa02621 | 942 | GB_BA1:CGL133719 | 1839 | AJ133719 | Corynebacterium glutamicum yjcC gene, amtR gene and citE gene, partial. | Corynebacterium glutamicum | 36,858 | Aug. 12, 1999 |
| | | GB_IN1:CEM106 | 39973 | Z46493 | Caenorhabditis elegans cosmid M106, complete sequence. | Caenorhabditis elegans | 37,608 | Sep. 2, 1999 |
| | | GB_EST29:AI547662 | 377 | AI547662 | UI-R-C3-sz-h-03-0-UI.s1 UI-R-C3 Rattus norvegicus cDNA clone UI-R-C3-sz-h-03-0-UI 3', mRNA sequence. | Rattus norvegicus | 50,667 | Jul. 3, 1999 |
| rxa02640 | 1650 | GB_BA1:MTV025 | 121125 | AL022121 | Mycobacterium tuberculosis H37Rv complete genome; segment 155/162. | Mycobacterium tuberculosis | 39,187 | Jun. 24, 1999 |
| | | GB_BA1:PAU49666 | 4495 | U49666 | Pseudomonas aeruginosa (orfX), glycerol diffusion facilitator (glpF), glycerol kinase (glpK), and Glp repressor (glpR) genes, complete cds, and (orfK) gene, partial cds. | Pseudomonas aeruginosa | 59,273 | May 18, 1997 |
| | | GB_BA1:AB015974 | 1641 | AB015974 | Pseudomonas tolaasii glpK gene for glycerol kinase, complete cds. | Pseudomonas tolaasii | 58,339 | Aug. 28, 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02654 | 1008 | GB_EST6:N65787 | 512 | N65787 | 20827 Lambda-PRL2 Arabidopsis thaliana cDNA clone 232B7T7, mRNA sequence. | Arabidopsis thaliana | 39,637 | Jan. 5, 1998 |
| | | GB_PL2:T17H3 | 65839 | AC005916 | Arabidopsis thaliana chromosome 1 BAC T17H3 sequence, complete sequence. | Arabidopsis thaliana | 33,735 | Aug. 5, 1999 |
| | | GB_RO:MMU58105 | 88871 | U58105 | Mus musculus Btk locus, alpha-D-galactosidase A (Ags), ribosomal protein (L44L), and Bruton's tyrosine kinase (Btk) genes, complete cds. | Mus musculus | 35,431 | Feb. 13, 1997 |
| rxa02666 | 891 | GB_PR3:AC004643 | 43411 | AC004643 | Homo sapiens chromosome 16, cosmid clone 363E3 (LANL), complete sequence. | Homo sapiens | 38,851 | May 1, 1998 |
| | | GB_PR3:AC004643 | 43411 | AC004643 | Homo sapiens chromosome 16, cosmid clone 363E3 (LANL), complete sequence. | Homo sapiens | 41,599 | May 1, 1998 |
| | | GB_BA2:AF049897 | 9196 | AF049897 | Corynebacterium glutamicum N-acetylglutamylphosphate reductase (argC), ornithine acetyltransferase (argJ), N-acetylglutamate kinase (argB), acetylornithine transaminase (argD), ornithine carbamoyltransferase (argF), arginine repressor (argR), argininosuccinate synthase (argG), and argininosuccinate lyase (argH) genes, complete cds. | Corynebacterium glutamicum | 40,413 | Jul. 1, 1998 |
| rxa02675 | 1980 | GB_BA1:PDENQQURF | 10425 | L02354 | Paracoccus denitrificans NADH dehydrogenase (URF4), (NQO8), (NQO9), (URF5), (URF6), (NQO10), (NQO11), (NQO12), (NQO13), and (NQO14) genes, complete cds's; biotin [acetyl-CoA carboxyl] ligase (birA) gene, complete cds. | Paracoccus denitrificans | 40,735 | May 20, 1993 |
| rxa02694 | 1065 | GB_BA1:MTCY339 | 42861 | Z77163 | Mycobacterium tuberculosis H37Rv complete genome; segment 101/162. | Mycobacterium tuberculosis | 36,471 | Jun. 17, 1998 |
| | | GB_BA1:MXADEVRS | 2452 | L19029 | Myxococcus xanthus devR and devS genes, complete cds's. | Myxococcus xanthus | 38,477 | Jan. 27, 1994 |
| | | GB_BA1:BACLDH | 1147 | M19394 | B. caldolyticus lactate dehydrogenase (LDH) gene, complete cds. | Bacillus caldolyticus | 57,371 | Apr. 26, 1993 |
| | | GB_BA1:BACLDHL | 1361 | M14788 | B. stearothermophilus lct gene encoding L-lactate dehydrogenase, complete cds. | Bacillus stearothermophilus | 57,277 | Apr. 26, 1993 |
| | | GB_PAT:A06664 | 1350 | A06664 | B. stearothermophilus lct gene. | Bacillus stearothermophilus | 57,277 | Jul. 29, 1993 |
| rxa02729 | 844 | GB_EST15:AA494626 | 121 | AA494626 | fa09d04.r1 Zebrafish ICRFzfls Danio rerio cDNA clone 11A22 5' similar to TR:G1171163 G1171163 G/T-MISMATCH BINDING PROTEIN. ; mRNA sequence. | Danio rerio | 50,746 | Jun. 27, 1997 |
| rxa02730 | 1161 | GB_EST15:AA494626 | 121 | AA494626 | fa09d04.r1 Zebrafish ICRFzfls Danio rerio cDNA clone 11A22 5' similar to TR:G1171163 G1171163 G/T-MISMATCH BINDING PROTEIN. ; mRNA sequence. | Danio rerio | 36,364 | Jun. 27, 1997 |
| | | GB_EST19:AA758660 | 233 | AA758660 | ah67d06.s1 Soares_testis_NHT Homo sapiens cDNA clone 1320683 3', mRNA sequence. | Homo sapiens | 37,059 | Dec. 29, 1998 |
| | | GB_EST15:AA494626 | 121 | AA494626 | fa09d04.r1 Zebrafish ICRFzfls Danio rerio cDNA clone 11A22 5' similar to TR:G1171163 G1171163 G/T-MISMATCH BINDING PROTEIN. ; mRNA sequence. | Danio rerio | 42,149 | Jun. 27, 1997 |
| rxa02737 | 1665 | GB_PR4:AC006285 | 150172 | AC006285 | Homo sapiens, complete sequence. | Homo sapiens | 37,655 | Nov. 15, 1999 |
| | | GB_PAT:E13655 | 2260 | E13655 | gDNA encoding glucose-6-phosphate dehydrogenase. | Corynebacterium glutamicum | 99,580 | Jun. 24, 1998 |
| | | GB_BA1:MTCY493 | 40790 | Z95844 | Mycobacterium tuberculosis H37Rv complete genome; segment 63/162. | Mycobacterium tuberculosis | 38,363 | Jun. 19, 1998 |
| | | GB_BA1:SC5A7 | 40337 | AL031107 | Streptomyces coelicolor cosmid 5A7. | Streptomyces coelicolor | 39,444 | Jul. 27, 1998 |
| rxa02738 | 1203 | GB_PAT:E13655 | 2260 | E13655 | gDNA encoding glucose-6-phosphate dehydrogenase. | Corynebacterium glutamicum | 98,226 | Jun. 24, 1998 |
| | | GB_BA1:SCC22 | 22115 | AL096839 | Streptomyces coelicolor cosmid C22. | Streptomyces coelicolor | 60,399 | Jul. 12, 1999 |
| | | GB_BA1:SC5A7 | 40337 | AL031107 | Streptomyces coelicolor cosmid 5A7. | Streptomyces coelicolor | 36,426 | Jul. 27, 1998 |
| rxa02739 | 2223 | GB_BA1:AB023377 | 2572 | AB023377 | Corynebacterium glutamicum tkt gene for transketolase, complete cds. | Corynebacterium glutamicum | 99,640 | Feb. 20, 1999 |
| | | GB_BA1:MLCL536 | 36224 | Z99125 | Mycobacterium leprae cosmid L536. | Mycobacterium leprae | 61,573 | Dec. 4, 1998 |
| | | GB_BA1:U00013 | 35881 | U00013 | Mycobacterium leprae cosmid B1496. | Mycobacterium leprae | 61,573 | Mar. 1, 1994 |
| rxa02740 | 1053 | GB_HTG2:AC006247 | 174368 | AC006247 | Drosophila melanogaster chromosome 2 clone BACR48I10 (D505) RPCI-98 48.I.10 map 49E6-49F8 strain y; cn bw sp, *** SEQUENCING IN PROGRESS ***, 17 unordered pieces. | Drosophila melanogaster | 37,105 | Aug. 2, 1999 |
| | | GB_HTG2:AC006247 | 174368 | AC006247 | Drosophila melanogaster chromosome 2 clone BACR48I10 (D505) RPCI-98 48.I.10 map 49E6-49F8 strain y; cn bw sp, *** SEQUENCING IN PROGRESS ***, 17 unordered pieces. | Drosophila melanogaster | 37,105 | Aug. 2, 1999 |
| | | GB_HTG3:AC007150 | 121474 | AC007150 | Drosophila melanogaster chromosome 2 clone BACR16P13 (D597) RPCI-98 16.P.13 map 49E-49F strain y; cn bw sp, *** SEQUENCING IN PROGRESS ***, 87 unordered pieces. | Drosophila melanogaster | 38,728 | Sep. 20, 1999 |

TABLE 4-continued

ALIGNMENT RESULTS

| ID # | length (NT) | Genbank Hit | Length Accession | Name of Genbank Hit | Source of Genbank Hit | % homology (GAP) | Date of Deposit |
|---|---|---|---|---|---|---|---|
| rxa02741 | 1089 | GB_HTG2:AC004951 | 129429 AC004951 | *Homo sapiens* clone DJ1022I14, *** SEQUENCING IN PROGRESS ***, 14 unordered pieces. | *Homo sapiens* | 33,116 | Jun. 12, 1998 |
| | | GB_HTG2:AC004951 | 129429 AC004951 | *Homo sapiens* clone DJ1022I14, *** SEQUENCING IN PROGRESS ***, 14 unordered pieces. | *Homo sapiens* | 33,116 | Jun. 12, 1998 |
| rxa02743 | 1161 | GB_IN1:AB006546 | 931 AB006546 | *Ephydatia fluviatilis* mRNA for G protein α subunit 4, partial cds. | *Ephydatia fluviatilis* | 36,379 | Jun. 23, 1999 |
| | | GB_BA1:MLCL536 | 36224 Z99125 | *Mycobacterium leprae* cosmid L536. | *Mycobacterium leprae* | 48,401 | Dec. 4, 1998 |
| | | GB_BA1:U00013 | 35881 U00013 | *Mycobacterium leprae* cosmid B1496. | *Mycobacterium leprae* | 48,401 | Mar. 1, 1994 |
| | | GB_HTG2:AC007401 | 83657 AC007401 | *Homo sapiens* clone NH0501O07, *** SEQUENCING IN PROGRESS ***, 3 unordered pieces. | *Homo sapiens* | 37,128 | Jun. 26, 1999 |
| rxa02797 | 1026 | GB_BA1:CGBETPGEN | 2339 X93514 | *C. glutamicum* betP gene. | *Corynebacterium glutamicum* | 38,889 | Sep. 8, 1997 |
| | | GB_GSS9:AQ148714 | 405 AQ148714 | HS_3136_A1_A03_MR CIT Approved Human Genomic Sperm Library D *Homo sapiens* genomic clone Plate = 3136 Col = 5 Row = A, genomic survey sequence. | *Homo sapiens* | 34,321 | Oct. 8, 1998 |
| | | GB_BA1:BFU64514 | 3837 U64514 | *Bacillus firmus* dppABC operon, dipeptide transporter protein dppA gene, partial cds, and dipeptide transporter proteins dppB and dppC genes, complete cds. | *Bacillus firmus* | 38,072 | Feb. 1, 1997 |
| rxa02803 | 680 | GB_BA1:U00020 | 36947 U00020 | *Mycobacterium leprae* cosmid B229. | *Mycobacterium leprae* | 34,462 | Mar. 1, 1994 |
| | | GB_BA2:PSU85643 | 4032 U85643 | *Pseudomonas syringae* pv. *syringae* putative dihydropteroate synthase gene, partial cds, regulatory protein MrsA (mrsA), triose phosphate isomerase (tpiA), transport protein SecG (secG), tRNA-Leu, tRNA-Met, and 15 kDa protein genes, complete cds. | *Pseudomonas syringae* pv. *syringae* | 50,445 | Apr. 9, 1997 |
| rxa02821 | 363 | GB_BA1:SC6G4 | 41055 AL031317 | *Streptomyces coelicolor* cosmid 6G4. | *Streptomyces coelicolor* | 59,314 | Aug. 20, 1998 |
| | | GB_HTG2:AC008105 | 91421 AC008105 | *Homo sapiens* chromosome 17 clone 2020_K_17 map 17, *** SEQUENCING IN PROGRESS ***, 12 unordered pieces. | *Homo sapiens* | 37,607 | Jul. 22, 1999 |
| | | GB_HTG2:AC008105 | 91421 AC008105 | *Homo sapiens* chromosome 17 clone 2020_K_17 map 17, *** SEQUENCING IN PROGRESS ***, 12 unordered pieces. | *Homo sapiens* | 37,607 | Jul. 22, 1999 |
| | | GB_EST33:AV117143 | 222 AV117143 | AV117143 *Mus musculus* C57BL/6J 10-day embryo *Mus musculus* cDNA clone 2610200I17, mRNA sequence. | *Mus musculus* | 40,157 | Jun. 30, 1999 |
| rxa02829 | 373 | GB_HTG1:HSU9G8 | 48735 AL008714 | *Homo sapiens* chromosome X clone LL0XNC01-9G8, *** SEQUENCING IN PROGRESS ***, in unordered pieces. | *Homo sapiens* | 41,595 | Nov. 23, 1999 |
| | | GB_HTG1:HSU9G8 | 48735 AL008714 | *Homo sapiens* chromosome X clone LL0XNC01-9G8, *** SEQUENCING IN PROGRESS ***, in unordered pieces. | *Homo sapiens* | 41,595 | Nov. 23, 1999 |
| | | GB_PR3:HSU85B5 | 39550 Z69724 | Human DNA sequence from cosmid U85B5, between markers DXS366 and DXS87 on chromosome X. | *Homo sapiens* | 41,595 | Nov. 23, 1999 |
| rxc03216 | 1141 | GB_HTG3:AC008184 | 151720 AC008184 | *Drosophila melanogaster* chromosome 2 clone BACR04D05 (D540) RPCI-98 04.D.5 map 36E5-36F2 strain y; cn bw sp. *** SEQUENCING IN PROGRESS ***, 27 unordered pieces. | *Drosophila melanogaster* | 39,600 | Aug. 2, 1999 |
| | | GB_EST15:AA477537 | 411 AA477537 | zn36g12.r1 Soares ovary tumor NbHOT *Homo sapiens* cDNA clone IMAGE:740134 5' similar to contains Alu repetitive element; contains element HGR repetitive element; mRNA sequence. | *Homo sapiens* | 37,260 | Nov. 9, 1997 |
| rxs03215 | 1038 | GB_EST26:AI330662 | 412 AI330662 | fa91d08.y1 zebrafish fin day1 regeneration *Danio rerio* cDNA 5', mRNA sequence. | *Danio rerio* | 37,805 | Dec. 28, 1998 |
| | | GB_BA1:SC3F9 | 19830 AL023862 | *Streptomyces coelicolor* cosmid 3F9. | *Streptomyces coelicolor* A3(2) | 48,657 | Feb. 10, 1999 |
| | | GB_BA1:SLLINC | 36270 X79146 | *S. lincolnensis* (78-11) Lincomycin production genes. | *Streptomyces lincolnensis* | 39,430 | May 15, 1996 |
| | | GB_HTG5:AC009660 | 204320 AC009660 | *Homo sapiens* chromosome 15 clone RP11-424J10 map 15, *** SEQUENCING IN PROGRESS ***, 41 unordered pieces. | *Homo sapiens* | 35,151 | Dec. 4, 1999 |
| rxs03224 | 1288 | GB_PR3:AC004076 | 41322 AC004076 | *Homo sapiens* chromosome 19, cosmid R30217, complete sequence. | *Homo sapiens* | 37,788 | Jan. 29, 1998 |
| | | GB_PL2:SPAC926 | 23193 AL110469 | *S. pombe* chromosome I cosmid c926. | *Schizosaccharomyces pombe* | 38,474 | Sep. 2, 1999 |
| | | GB_BA2:AE001081 | 11473 AE001081 | *Archaeoglobus fulgidus* section 26 of 172 of the complete genome. | *Archaeoglobus fulgidus* | 35,871 | Dec. 15, 1997 |

SEQUENCE LISTING (784 sequences)

SEQ ID NO: 1 - DNA, 828 bp, Corynebacterium glutamicum
  CDS (101)..(805): RXS02735
gaggagcttcgccacatggatccagatttgggctaccagcacgcactatccggcttgtccagcgtcaagctggaaaccgtctaaggagaaatacaacactatggttgatgtagtacgcgcacgcgatactgaagatttggttgcacaggctgcctccaaattcattgaggttgttgaagcagcaactgccaataatggcaccgcacaggtagtgctcaccggtggtggcgccggcatcaagttgctggaaaagctcagcgttgatgcggctgaccttgcctgggatcgcattcatgtgttcttcggcgatgagcgcaatgtccctgtcagtgattctgagtccaatgagggccaggctcgtgaggcactgttgtccaaggtttctatccctgaagccaacattcacggatatggtctcggcgacgtagatcttgcagaggcagcccgcgcttacgaagctgtgttggatgaattcgcaccaaacggctttgatcttcacctgctcggcatgggtggcgaaggccatatcaactccctgttccctcacaccgatgcagtcaaggaatcctccgcaaaggtcatcgcggtgtttgattcccctaagcctccttcagagcgtgcaactctaacccttcctgcggttcactccgcaaagcgcgtgtggttgctggtttctggtgcggagaaggctgaggcagctgcggcgatcgtcaacggtgagcctgctgttgagtggcctgctgctggagctaccggatctgaggaaacggtattgttcttggctgatgatgctgcaggaaatctctaagcagcgccagctctaacaag

SEQ ID NO: 2 - protein, 235 aa, Corynebacterium glutamicum
MVDVVRARDTEDLVAQAASKFIEVVEAATANNGTAQVVLTGGGAGIKLLEKLSVDAADLAWDRIHVFFGDERNVPVSDSESNEGQAREALLSKVSIPEANIHGYGLGDVDLAEAARAYEAVLDEFAPNGFDLHLLGMGGEGHINSLFPHTDAVKESSAKVIAVFDSPKPPSERATLTLPAVHSAKRVWLLVSGAEKAEAAAAIVNGEPAVEWPAAGATGSEETVLFLADDAAGNL

SEQ ID NO: 3 - DNA, 468 bp, Corynebacterium glutamicum
  CDS (101)..(445): RXA01626
gcaatagcgaatgcgtaattaaccacacttcaaacctagcccctcaggtggaggattccgacattaccgtctgaaaaatttcatccgtaggctaaagagcatgtcgaaaacgatcatcgtgcgcaccgaaattgaaatccctggacacccaaccgccatccatatcgcagagatgcaggagcttcccccatctgaggctcaaggcggcgtgcagatgtgcaaaatgcagcgcattattgaactagcaggaactgccgaaggggatgtcgttactggtgcaggtgttattggcggatctaatttccagctgaataacgagccaaatgaagtggttccccatccagatacctatgcggatttccccgatatcaaggcggttgttatctccgcggagacttttgaaggcctgtggctggaagcgggagcgaagttccctgggttaaattaaccacttgcagtataccctag

SEQ ID NO: 4 - protein, 115 aa, Corynebacterium glutamicum
MSKTIIVRTEIEIPGHPTAIHIAEMQELPPSEAQGGVQMCKMQRIIELAGTAEGDVVTGAGVIGGSNFQLNNEPNEVVPHPDTYADFPDIKAVVISAETFEGLWLEAGAKFPGLN

SEQ ID NO: 5 - DNA, 780 bp, Corynebacterium glutamicum
  CDS (101)..(757): RXA02245
gccacaccgccacggcaccgatgcgatgtttgtggcagtgctgcgaaagaagtagacctgtgagctaagtggggtagacaagagggctatgatttagggcatggcacaacgtactccactaatcgccccatccattcttgctgctgatttctcccgcttaggggagcaggtgttggctgttcctgatgctgactggattcacgtcgacatcatggacggacacttcgttccaaacttgagctttggcgcggatatcacagctgcggtcaaccgcgttacggacaaagaactagacgtccacctgatgatcgaaaacccagagaagtgggtggacaactacatcgacgctggcgcggactgcattgttttccacgttgaagccaccgaaggtcacgttgagttggctaagtacatccgttccaagggtgtgcgtgcaggtttctccctgcgccctggaactcccatcgaggattacttggatgacctcgagcacttcgatgaagtcatcgtcatgagcgtcgagcctggattcggtggccaaagcttcatgcctgaacaactggaaaaggttcgtaccctgcgcaaggtcatcgatgagcgcggtctgaacaccgtcatcgagatcgacggcggcattagcgccaagaccatcaagcaggctgccgacgctggcgtggatgccttcgttgcaggttccgctgtgtacggcgctgaggatcccaacaaggcgatccaggagttgcgagcactcgcgcagtaaatggatgttgcgcacgcgtt

SEQ ID NO: 6 - protein, 219 aa, Corynebacterium glutamicum
MAQRTPLIAPSILAADFSRLGEQVLAVPDADWIHVDIMDGHFVPNLSFGADITAAVNRVTDKELDVHLMIENPEKWVDNYIDAGADCIVFHVEATEGHVELAKYIRSKGVRAGFSLRPGTPIEDYLDDLEHFDEVIVMSVEPGFGGQSFMPEQLEKVRTLRKVIDERGLNTVIEIDGGISAKTIKQAADAGVDAFVAGSAVYGAEDPNKAIQELRALAQ

SEQ ID NO: 7 - DNA, 442 bp, Corynebacterium glutamicum
  CDS (101)..(442): RXA01015
ccaagattgagtcgagctattttgcgatttgtgaacccccaaataggggaaaagtccgggtatccgccgttgtgaaaatgcctgcagtaaactgacttccatgcgcgtataccttggagcagaccacgctggtttcgaaactaaaaatgcaatcgcagaacaccttaaggcccacggccacgaagtgatcgactgcggagcccacacctatgatgcagaagatgactacccagccttctgcatcgaagcagctagccgcacagtaaacgacccaggctcactcggcatcgtcctgggtggatccggaaacggcgagcagatcgccgccaacaaggtcaagggtgcacgttgtgcacttgcttggtctgttgaaactgcacgcctcgcccgcgagcacaacaatgcgaacctcatcggcatcggcggccgcatgcactcagag

SEQ ID NO: 8 - protein, 114 aa, Corynebacterium glutamicum
MRVYLGADHAGFETKNAIAEHLKAHGHEVIDCGAHTYDAEDDYPAFCIEAASRTVNDPGSLGIVLGGSGNGEQIAANKVKGARCALAWSVETARLAREHNNANLIGIGGRMHSE

SEQ ID NO: 9 - DNA, 2142 bp, Corynebacterium glutamicum
  CDS (101)..(2119): RXN01312
gcagttgcgtacatcgttcctgcactggtcctgatcggcaacatcaccattccgttcgccatcgctgttggttggattgcgtaaaggttaggaagaatttatgagcactcactctgaaaccacccgcccagagttcatccacccagtctcagtcctcccagaggtctcagctggtacggtccttgacgctgcagagccagcaggcgttcccaccaaagatatgtgggaataccaaaaagaccacatgaacctggtctccccactgaaccgacgcaagttccgtgtcctcgtcgttggcaccggcctgtccggtggtgctgcagcagcagccctcggcgaactcggatacgacgtcaaggcgttcacctaccacgacgcacctcgccgtgcgcactccattgctgcacagggtggcgttaactccgcccgcggcaagaaggtagacaacgacggcgcataccgccacgtcaaggacaccgtcaagggcggcgactaccgtggtcgcgagtccgactgctggcgtctcgccgtcgagtccgtccgcgtcatcgaccacatgaacgccatcggtgcaccattcgcccgcgaatacggtggcgccttggcaacccgttccttcggtggtgtgcaggtctcccgtacctactacacccgtggacaaaccggacagcagctgcagttctccaccgcatccgcactacagcgccagatccacctcggctccgtagaaatcttcacccataacgaaatggttgacgtcattgtcaccgaacgtaacggtgaaaagcgctgcgaaggcctgatcatgcgcaacctgatcaccggcgagctcaccgcacacaccggccatgccgttatcctggcaaccggtggctacggcaacgtgtaccacatgtccaccctggccaagaactccaacgcctcggccatcatgcgtgcatacgaagccggcgcatacttcgcgtccccatcgttcatccagttccacccaaccggcctgcctgtgaactccacctggcagtccaagaccattctgatgtccgagtcgctgcgtaacgacggccgcatctggtcccctaaggaaccgaacgataaccgcgatccaaacaccatccctgaggatgagcgcgactacttcctggagcgccgctacccagcattcggtaacctcgtcccacgtgacgttgcttcccgtgcgatctcccagcagatcaatgctggtctcggtgttggacctctgaacaacgctgcatacctggacttccgcgacgccaccgagcgcctcggacaggacaccatccgcgagcgttactccaacctcttcaccatgtacgaagaggcaattggcgaggacccatactccagcccaatgcgtattgcaccgacctgccacttcaccatgggtggcctctggactgacttcaacgaaatgacgtcactcccaggtctgttctgcgcaggcgaagcatcctggacctaccacggtgcaaaccgtctgggcgcaaactccctgctctccgcttccgtcgatggctggttcaccctgccattcaccatccctaactacctcggcccattgcttggctccgagcgtctgtcagaggatgcaccagaagcacaggcagcgattgcgcgtgcacaggctcgcattgaccgcctcatgggcaaccgcccagagtgggtcggtgacaacgttcacggacctgagtactaccaccgccagcttggcgatatcctgtacttctcctgtggcgtttcccgaaacgtagaagacctccaggatggcatcaacaagatccgtgccctccgcgatgacttctggaagaacatgcgcatcaccggcagcaccgatgagatgaaccaggttctcgaatacgcagcacgcgtagccgactacatcgacctcggcgaactcatgtgtgtcgacgccctcgaccgcgacgagtcctgtggcgctcacttccgcgacgaccacctctccgaagatggcgaagcacaacgtgacgaccaaaactggtgcttcgtctccgcatgggaaccaggcgagaatggaaccttcgtctgccacgcagaaccactgttcttcgaatctgtcccactgcagacaaggaactacaagtaatgaaacttacacttgagatc

SEQ ID NO: 10 - protein, 673 aa, Corynebacterium glutamicum
MSTHSETTRPEFIHPVSVLPEVSAGTVLDAAEPAGVPTKDMWEYQKDHMNLVSPLNRRKFRVLVVGTGLSGGAAAAALGELGYDVKAFTYHDAPRRAHSIAAQGGVNSARGKKVDNDGAYRHVKDTVKGGDYRGRESDCWRLAVESVRVIDHMNAIGAPFAREYGGALATRSFGGVQVSRTYYTRGQTGQQLQFSTASALQRQIHLGSVEIFTHNEMVDVIVTERNGEKRCEGLIMRNLITGELTAHTGHAVILATGGYGNVYHMSTLAKNSNASAIMRAYEAGAYFASPSFIQFHPTGLPVNSTWQSKTILMSESLRNDGRIWSPKEPNDNRDPNTIPEDERDYFLERRYPAFGNLVPRDVASRAISQQINAGLGVGPLNNAAYLDFRDATERLGQDTIRERYSNLFTMYEEAIGEDPYSSPMRIAPTCHFTMGGLWTDFNEMTSLPGLFCAGEASWTYHGANRLGANSLLSASVDGWFTLPFTIPNYLGPLLGSERLSEDAPEAQAAIARAQARIDRLMGNRPEWVGDNVHGPEYYHRQLGDILYFSCGVSRNVEDLQDGINKIRALRDDFWKNMRITGSTDEMNQVLEYAARVADYIDLGELMCVDALDRDESCGAHFRDDHLSEDGEAQRDDQNWCFVSAWEPGENGTFVCHAEPLFFESVPLQTRNYK

SEQ ID NO: 11 - DNA, 1100 bp, Corynebacterium glutamicum
  CDS (1)..(1077): FRXA01312
gagtcgctgcgtaacgacggccgcatctggtcccctaaggaaccgaacgataaccgcgatccaaacaccatccctgaggatgagcgcgactacttcctggagcgccgctacccagcattcggtaacctcgtcccacgtgacgttgcttcccgtgcgatctcccagcagatcaatgctggtctcggtgttggacctctgaacaacgctgcatacctggacttccgcgacgccaccgagcgcctcggacaggacaccatccgcgagcgttactccaacctcttcaccatgtacgaagaggcaattggcgaggacccatactccagcccaatgcgtattgcaccgacctgccacttcaccatgggtggcctctggactgacttcaacgaaatgacgtcactcccaggtctgttctgcgcaggcgaagcatcctggacctaccacggtgcaaaccgtctgggcgcaaactccctgctctccgcttccgtcgatggctggttcaccctgccattcaccatccctaactacctcggcccattgcttggctccgagcgtctgtcagaggatgcaccagaagcacaggcagcgattgcgcgtgcacaggctcgcattgaccgcctcatgggcaaccgcccagagtgggtcggtgacaacgttcacggacctgagtactaccaccgccagcttggcgatatcctgtacttctcctgtggcgtttcccgaaacgtagaagacctccaggatggcatcaacaagatccgtgccctccgcgatgacttctggaagaacatgcgcatcaccggcagcaccgatgagatgaaccaggttctcgaatacgcagcacgcgtagccgactacatcgacctcggcgaactcatgtgtgtcgacgccctcgaccgcgacgagtcctgtggcgctcacttccgcgacgaccacctctccgaagatggcgaagcacaacgtgacgaccaaaactggtgcttcgtctccgcatgggaaccaggcgagaatggaaccttcgtctgccacgcagaaccactgttcttcgaatctgtcccactgcagacaaggaactacaagtaatgaaacttacacttgagatc

SEQ ID NO: 12 - protein, 359 aa, Corynebacterium glutamicum
ESLRNDGRIWSPKEPNDNRDPNTIPEDERDYFLERRYPAFGNLVPRDVASRAISQQINAGLGVGPLNNAAYLDFRDATERLGQDTIRERYSNLFTMYEEAIGEDPYSSPMRIAPTCHFTMGGLWTDFNEMTSLPGLFCAGEASWTYHGANRLGANSLLSASVDGWFTLPFTIPNYLGPLLGSERLSEDAPEAQAAIARAQARIDRLMGNRPEWVGDNVHGPEYYHRQLGDILYFSCGVSRNVEDLQDGINKIRALRDDFWKNMRITGSTDEMNQVLEYAARVADYIDLGELMCVDALDRDESCGAHFRDDHLSEDGEAQRDDQNWCFVSAWEPGENGTFVCHAEPLFFESVPLQTRNYK

SEQ ID NO: 13 - DNA, 1593 bp, Corynebacterium glutamicum
  CDS (101)..(1570): RXN00231
caggactacctcgacgccggcgccaactttgtccgagtcggtgccgatgtccagcaactcaacgctgctggatacgaaaagtgaaggaaaataacgcatcatgactattaatgttttcgaactacttgtcaaaagtcccacgggtctactgattggtgattcctgggtggaagcatccgacggcggtactttcgatgtggaaaacccagcgacgggtgaaacaatcgcaacgctcgcgtctgctacttccgaggatgcactggctgctcttgatgctgcatgcgctgttcaggccgagtgggctaggatgccagcgcgcgagcgttctaatattttacgccgcggttttgagctcgtagcagaacgtgcagaagagttcgccaccctcatgaccttggaaatgggcaagcctttggctgaagctcgcggcgaagtcacctacggcaacgaattcctgcgctggttctctgaggaagcagttcgtctgtatggccgttacggaaccacaccagaaggcaacttgcggatgctgaccgccctcaagccagttggcccgtgcctcctgatcaccccatggaacttcccactagcaatggctacccgcaaggtcgcacctgcgatcgctgcaggttgtgtcatggtgctcaagccagctcgacttaccccgctgacctcccagtattttgctcagaccatgcttgatgccggtcttccagcaggtgtcctcaatgtggtctccggtgcttccgcctctgcgatttccaacccgattatggaagacgatcgccttcgtaaagtctccttcaccggctccaccccagttggccagcagctgctcaaaaaggctgccgataaagttctgcgcacctccatggaacttggtggcaacgcacctttcattgtcttcgaggacgccgacctagatctcgcgatcgaaggtgccatgggtgccaaaatgcgcaacatcggcgaagcttgcaccgcagccaaccgtttcttagtccacgaatccgtcgccgatgaattcggccgtcgcttcgctgcccgccttgaagagcaagtcctaggcaacggcctcgacgaaggcgtcaccgtgggccccctggttgaggaaaaagcacgagacagcgttgcatcgcttgtcgacgccgccgtcgccgaaggtgccaccgtcctcaccggcggcaaggccggcacaggtgcaggctacttctacgaaccaacggtgctcacgggagtttcaacagatgcggctatcctgaacgaagagatcttcggtcccgtcgcaccgatcgtcaccttccaaaccgaggaagaagccctgcgtctagccaactccaccgaatacggactggcctcctatgtgttcacccaggacacctcacgtattttccgcgtctccgatggtctcgagttcggcctagtgggcgtcaattccggtgtcatctctaacgctgctgcaccttttggtggcgtaaaacaatccggaatgggccgcgaaggtggtctcgaaggaatcgaggagtacacctccgtgcagtacatcggtatccgggatccttacgccggctagcatctgcccctttacaaatc

SEQ ID NO: 14 - protein, 490 aa, Corynebacterium glutamicum
MTINVFELLVKSPTGLLIGDSWVEASDGGTFDVENPATGETIATLASATSEDALAALDAACAVQAEWARMPARERSNILRRGFELVAERAEEFATLMTLEMGKPLAEARGEVTYGNEFLRWFSEEAVRLYGRYGTTPEGNLRMLTALKPVGPCLLITPWNFPLAMATRKVAPAIAAGCVMVLKPARLTPLTSQYFAQTMLDAGLPAGVLNVVSGASASAISNPIMEDDRLRKVSFTGSTPVGQQLLKKAADKVLRTSMELGGNAPFIVFEDADLDLAIEGAMGAKMRNIGEACTAANRFLVHESVADEFGRRFAARLEEQVLGNGLDEGVTVGPLVEEKARDSVASLVDAAVAEGATVLTGGKAGTGAGYFYEPTVLTGVSTDAAILNEEIFGPVAPIVTFQTEEEALRLANSTEYGLASYVFTQDTSRIFRVSDGLEFGLVGVNSGVISNAAAPFGGVKQSGMGREGGLEGIEEYTSVQYIGIRDPYAG

SEQ ID NO: 15 - DNA, 870 bp, Corynebacterium glutamicum
  CDS (101)..(847): RXA01311
tcgtctccgcatgggaaccaggcgagaatggaaccttcgtctgccacgcagaaccactgttcttcgaatctgtcccactgcagacaaggaactacaagtaatgaaacttacacttgagatctggcgtcaagcaggcccaactgcggaaggcaagttcgaaaccgtccaggttgacgacgccgtcgcgcagatgtccatcctggagctgcttgaccacgtaaacaacaagttcatcgaagaaggcaaagaaccattcgcgttcgcctctgactgccgcgaaggcatttgtggtacctgtggtctcctcgtgaacggtcgccctcacggcgccgaccagaacaagcctgcctgtgcgcagcgcctggtcagctacaaggaaggcgacaccctcaagatcgaaccactgcgttccgccgcatacccagtgatcaaggacatggtcgtcgaccgctccgcactggaccgtgtcatggaacagggtggctacgtgaccatcaacgcaggtaccgcacctgacgctgataccctccacgtcaaccacgaaaccgcagaactcgcacttgaccacgcagcctgcatcggctgtggcgcatgtgttgctgcctgccctaacggcgcagcacacctgttcaccggcgcaaagcttgttcacctctccctcctcccactgggtaaggaagagcgcggactgcgtgcacgtaagatggttgatgaaatggaaaccaacttcggacactgctccctctacggcgagtgcgcagatgtctgccccgcaggcatcccactgaccgctgtggcagctgtcaccaaggaacgtgcgcgtgcagctttccgaggcaaagacgactagtctttaatccaagtaagtac

SEQ ID NO: 16 - protein, 249 aa, Corynebacterium glutamicum
MKLTLEIWRQAGPTAEGKFETVQVDDAVAQMSILELLDHVNNKFIEEGKEPFAFASDCREGICGTCGLLVNGRPHGADQNKPACAQRLVSYKEGDTLKIEPLRSAAYPVIKDMVVDRSALDRVMEQGGYVTINAGTAPDADTLHVNHETAELALDHAACIGCGACVAACPNGAAHLFTGAKLVHLSLLPLGKEERGLRARKMVDEMETNFGHCSLYGECADVCPAGIPLTAVAAVTKERARAAFRGKDD

SEQ ID NO: 17 - DNA, 1530 bp, Corynebacterium glutamicum
  CDS (101)..(1507): RXA01535
acccacctcactctaggggtggactccagtgtttcgcgacaacacaatgagtaagcttgtgacagccgtatttaattctcagtaagaaatgagtgatttcatgaccgagcaggaattccgtattgagcacgacaccatgggtgaagtgaaggttccagcaaaggctctgtggcaggcacagacccagcgcgctgttgagaacttccctatctctggtcgtggtctggaatccgcacagatccgcgcaatgggtctgctgaaggcagcttgtgcgcaggtaaacaaggactccggtgcgctggatgcagagaaggcagatgccatcattgcagctggtaaggagatcgcgtccggtaagcatgacgctgagttcccaattgatgtgttccagactggttccggtacttcctccaacatgaacaccaatgaggttatcgcttccatcgcgaaggctaacggcgttgaggttcacccaaatgaccacgtcaacatgggtcagtcctccaatgacaccttccctactgcaactcacgttgctgcaaccgaagctgctgtcaatgacctcatcccaggcctgaaggttctgcacgagtctttggcgaagaaggctaacgagtggtctgaggttgttaagtccggccgcacccacctgatggacgctgttccagtaaccctgggccaggagttcggtggctacgctcgccagatccagctcggcatcgagcgcgttgaggctactcttcctcgccttggtgagctggctattggtggcaccgctgctggtaccggtatcaacacctccgctgatttcggcggcaaggttgttgctgaactgatcaacttgaccgacgtcaaggagctcaaggaagctgagaaccacttcgaggctcaggctgcacgcgacgctcttgttgagttctccggcgcaatgcgcgttatcgctgtctccttgtacaagatcgctaacgatatccgcctcatgggctccggcccactgaccggtcttggcgagatccgtctcccagacctgcagccaggttcctccatcatgccaggcaaggtcaacccagttctctgtgagaccgctacccaggtttccgctcaggttatcggcaatgacgcagctgttgcgttctccggcacccagggccagttcgagctcaacgtgttcatcccagtgatggctcgcaacgtgcttgagtccgctcgcctgctggctaacacttcccgcgtgttcgcaacccgtctcgttgatggcattgagccaaacgaggcacacatgaaggagctcgctgagtcttcaccttccatcgttaccccactgaactctgcaatcggctacgaagctgctgcaaaggtggctaagactgctttggctgagggcaagaccatccgccagactgtcatcgatttgggcttggttgatggcgagaagctcaccgaggaagagctggacaagcgcctcgacgttcttgctatggctcacaccgagcgcgagaacaagttctaaaactagaacccgataaataa

SEQ ID NO: 18 - protein, 469 aa, Corynebacterium glutamicum
MTEQEFRIEHDTMGEVKVPAKALWQAQTQRAVENFPISGRGLESAQIRAMGLLKAACAQVNKDSGALDAEKADAIIAAGKEIASGKHDAEFPIDVFQTGSGTSSNMNTNEVIASIAKANGVEVHPNDHVNMGQSSNDTFPTATHVAATEAAVNDLIPGLKVLHESLAKKANEWSEVVKSGRTHLMDAVPVTLGQEFGGYARQIQLGIERVEATLPRLGELAIGGTAAGTGINTSADFGGKVVAELINLTDVKELKEAENHFEAQAARDALVEFSGAMRVIAVSLYKIANDIRLMGSGPLTGLGEIRLPDLQPGSSIMPGKVNPVLCETATQVSAQVIGNDAAVAFSGTQGQFELNVFIPVMARNVLESARLLANTSRVFATRLVDGIEPNEAHMKELAESSPSIVTPLNSAIGYEAAAKVAKTALAEGKTIRQTVIDLGLVDGEKLTEEELDKRLDVLAMAHTERENKF

SEQ ID NO: 19 - DNA, 1164 bp, Corynebacterium glutamicum
  CDS (101)..(1141): RXA00517
ggtcttagaaccagcgtgcactgatggcgattaaagggggttgcgcctatacctattgctggtatacatttcggtatacctaaaccgaattgagggattcatgccagaagtcactgtcaacgcccaacaactcactgttctctgcacagacatcctcaccaaaactggagtacctgcagcagacgcccatcttgtcggtgatagtttggtgcaggctgatctttggggtcacccctcccacggtgtgcttcgactgccttggtatgtgcgcagactccacagtggcgcgatgactacacatgcacacgtggaggttctcaatgatttgggtgccgtgttggcgttggatggacacaatggaatcggccaagttttagctgatcatgctcgtaaagaagcagtgactagggcaatgatgttcggcatcggtgcggtgtcggtgcgcaactccaatcattttggaactgccatgtactacacccggaaagcggcagcgcaaggatgtgtttccattctcaccaccaatgcatctccggcgatggcgccctggggtggcagagaaaaacggatcggtaccaacccatggtctattgcggcaccttttggagaaacggctacggtagtcgatatagccaatactgcggttgcgcgcggaaagatctaccacgcacgacagacaaacatgcccattcctgagacttgggcgatcacgagtgagggcgcacccaccacggatcctgctgaggcaatcaacggtgtcgtccttcccatggctggtcacaaaggttatgcgattagcttcatgatggatgtgctttctggagttctcactggttcccagcacagcaccaaggtacatggtccgtatgatcccactcccccaggtggagctggccacttgttcatcgcgttggatgttgcagcgtttcgcgatccacaagatttcgatgacgcactcagcgatctggttggggaagttaaatccactccgaaagcacaaaacaccgaggagattttctaccccggtgaatcggaagaccgtgcgcatcggaaaaactctgcgcacggtatttcattgcctgaaaaaacgtggatggaactgcaagaactggcaatcgagaaccatgttgtaactcaccgttgatctgcgcgttaaacctggcc

SEQ ID NO: 20 - protein, 347 aa, Corynebacterium glutamicum
MPEVTVNAQQLTVLCTDILTKTGVPAADAHLVGDSLVQADLWGHPSHGVLRLPWYVRRLHSGAMTTHAHVEVLNDLGAVLALDGHNGIGQVLADHARKEAVTRAMMFGIGAVSVRNSNHFGTAMYYTRKAAAQGCVSILTTNASPAMAPWGGREKRIGTNPWSIAAPFGETATVVDIANTAVARGKIYHARQTNMPIPETWAITSEGAPTTDPAEAINGVVLPMAGHKGYAISFMMDVLSGVLTGSQHSTKVHGPYDPTPPGGAGHLFIALDVAAFRDPQDFDDALSDLVGEVKSTPKAQNTEEIFYPGESEDRAHRKNSAHGISLPEKTWMELQELAIENHVVTHR

SEQ ID NO: 21 - DNA, 1107 bp, Corynebacterium glutamicum
  CDS (101)..(1084): RXA01350
tgcagtatcgtcaagatcacccaaaactggtggctgttctcttttaagcgggatagcatgggttcttagaggaccccctacaaggattgaggattgtttaatgaattccccgcagaacgtctccaccaagaaggtcaccgtcaccggcgcagctggtcaaatctcttattcactgttgtggcgcatcgccaacggtgaagtattcggcaccgacacccctgtagaactgaaacttctggagatccctcaggctcttggcggggcagagggtgtggctatggaacttctggattctgccttccccctcctgcgaaacatcaccatcaccgcggatgccaatgaggcattcgacggcgctaatgcggcgtttttggtcggtgcgaagcctcgcggaaaaggcgaagagcgcgcagatttgctggctaacaacggcaagattttcggacctcaaggtaaagctatcaatgacaacgccgcagatgacattcgtgtcctagttgttggaaacccagcgaacaccaacgcgttgattgcttcagctgcggccccagatgttccagcatcccgcttcaacgcaatgatgcgccttgatcacaaccgtgcgatctcccagctggccaccaagcttggccgtggatctgcggaatttaacaacattgtggtctggggaaatcactccgcaacccagttcccagacatcacctacgcaaccgttggtggagaaaaggtcactgacctggttgatcacgattggtatgtggaggagttcattcctcgcgtggctaaccgtggcgctgaaatcattgaggtccgtggaaagtcttctgcagcttctgcagcatcctctgcgattgatcacatgcgcgattgggtacagggcaccgaggcgtggtcctctgcggcaattccttccaccggtgcatacggcattcctgagggcatttttgtcggtctgccaaccgtatcccgcaacggtgagtgggaaatcgttgaaggcctggagatttccgatttccagcgcgcccgcatcgacgcgaatgctcaggaattgcaggccgagcgcgaggcagtgcgcgacttgctctaatctttaacgcatgacttcgc

SEQ ID NO: 22 - protein, 328 aa, Corynebacterium glutamicum
MNSPQNVSTKKVTVTGAAGQISYSLLWRIANGEVFGTDTPVELKLLEIPQALGGAEGVAMELLDSAFPLLRNITITADANEAFDGANAAFLVGAKPRGKGEERADLLANNGKIFGPQGKAINDNAADDIRVLVVGNPANTNALIASAAAPDVPASRFNAMMRLDHNRAISQLATKLGRGSAEFNNIVVWGNHSATQFPDITYATVGGEKVTDLVDHDWYVEEFIPRVANRGAEIIEVRGKSSAASAASSAIDHMRDWVQGTEAWSSAAIPSTGAYGIPEGIFVGLPTVSRNGEWEIVEGLEISDFQRARIDANAQELQAEREAVRDLL

SEQ ID NO: 23 - DNA, 1092 bp, Corynebacterium glutamicum
  CDS (101)..(1069): RXA02149
ttgcagagtgaaccacgatgatggttggacagctgttgatagctaatctttgaaagattaaattcacctaaatcctgtgtagaacgcgaggggcactcttatgccacaaaaaccggccagtttcgcggtgggctttgacatcggcggcaccaacatgcgagccgggcttgtcgacgaatccgggcgcatcgtgaccagtttgtcggcgccgtcgccgcgcacgacgcaggcaatggaacaggggatttttgatctagtcgaacagctcaaggccgaatacccggttggtgctgtgggacttgccgtcgcgggatttttggatcctgagtgcgaggttgttcgatttgccccgcaccttccttggcgcgatgagccagtgcgtgaaaagttggaaaaccttttgggcctgcctgttcgtttggaacatgatgccaactcagcagcgtggggtgagcatcgttttggtgcagctcaaggcgctgacaactgggttttgttggcactcggcactggaattggtgcagcgctgattgaaaaaggcgaaatttaccgtggtgcatatggcacggcaccagaatttggtcatttgcgtgttgttcgtggcggacgcgcatgtgcgtgtggcaaagaaggctgcctggagcgttactgttccggtactgccttggtttacactgcgcgtgaattggcttcgcatggctcattccgcaacagcgggctgtttgacaagatcaaagccgatccgaattccatcaatggaaaaacgatcactgcggcagcgcgccaagaagacccacttgctctcgccgttctggaagatttcagcgagtggctgggcgaaactttggcgatcattgctgatgtccttgacccaggcatgatcatcattggtggcggactgtccaatgctgccgacctttatttggatcgctcggtcaaccactattccacccgcatcgtcggcgcaggatatcgccctttggcacgcgttgccacagctcagttgggtgcggatgctggcatgatcggtgtcgctgatctagctcgacgctctgtagtggaagccaactaggtgtttttcggtgggctgcg

SEQ ID NO: 24 - protein, 323 aa, Corynebacterium glutamicum
MPQKPASFAVGFDIGGTNMRAGLVDESGRIVTSLSAPSPRTTQAMEQGIFDLVEQLKAEYPVGAVGLAVAGFLDPECEVVRFAPHLPWRDEPVREKLENLLGLPVRLEHDANSAAWGEHRFGAAQGADNWVLLALGTGIGAALIEKGEIYRGAYGTAPEFGHLRVVRGGRACACGKEGCLERYCSGTALVYTARELASHGSFRNSGLFDKIKADPNSINGKTITAAARQEDPLALAVLEDFSEWLGETLAIIADVLDPGMIIIGGGLSNAADLYLDRSVNHYSTRIVGAGYRPLARVATAQLGADAGMIGVADLARRSVVEAN

SEQ ID NO: 25 - DNA, 1785 bp, Corynebacterium glutamicum
  CDS (101)..(1762): RXA01814
tgttaagccaccctactccgtgaattttgccgtatctcgtgcgcacaattgcttttgaggggaagatgaagagaaagtattggtgttttaaggagcaaacatggcacatgaacgcgccgggcaactcgcccaaccagaagatctcatcgatgttgcggaactggtcaccgcatatttcacccgcaagccggacgtgaacaaccctgatcagcaggtcgctttcggcacctccggacaccgtggcttcgcgctggacagcgctttcaacgaggaccacatcctggcaaccacccaggcgatcgtcgactaccgcaaccagcagccaaaaaactgggtcggcccgctgtttatcggccgcgatacgcacgcgctgtccgaaccagcgatgatcagcgcgcttgaggtcctcattgccaacgacgtcgaagtgcttgtcgacgccgacggccgctacaccccgacgcccgcagtgtcccacgcgatcctacgacacaacgatggcatcatccttggcaccgcaggaccctcccgcccctacgccgacggcatcgtgatcaccccatcccacaaccctcctcgtgatggcggattcaaatacaacccagccaacggtggccctgcagataccgacgccaccgactggatcgccaaccgcgccaacgatattctgcgcggcgaccttgcagacgtgaagcgagttccagtttccggtgtcctcgacgagcgcaccactgcctacgacttcaagggcatttacatcgctgacctgccaaacgtggtcaacatcgatgccatccgcgaagctggtgttcgaatcggcgcagacccaatgggtggcgcatccgtggattactggggtgccatcgcagaaacccatggcctcaacctcaccgtggtcaacccacacgttgattccaccttccgcttcatgacattggacaccgacggcaagatccgcatggactgctccagcccacacgcaatggcatcgctgattgacaaccgagacaagttcgatgtggcaaccggcaacgacgccgacgccgaccgccacggcatcgtcaccccagacgctggcttgatgaaccccaaccactacctcgcagtagcaattgagtacctctttgctcaccgcccaggttggtccgcagataccgcagtgggcaaaaccctggtcagctcctccatgatcgaccgcgttgtggcgcagcttggccgcaccctcgttgaggttccagtcggattcaagtggtttgtcccaggtttgatctccggcgaaatcggattcggtggtgaagaatccgcaggtgcatccttcctccgcatggacggcaccacctggtccaccgacaaggacggcctcatccttgacctcctggcagctgagatcattgcagtaaccggcaagaccccatcacagcgctacgcagaactcgccgaagaattcggtgcacctgcctacgcccgcaccgatgcagaagccaaccgagaacaaaaggccatcctgaaggcactgtccccagaacaggtcaccgccaccgaactagccggcgaagcaatcaccgctaagctcaccgaagctcccggcaatggcgcagccatcggaggactaaaagtgaccaccgaaaacgcctggttcgcagcacgcccatccggcaccgaagacaagtacaagatctacgcagaatccttcaagggcgaagagcacctcgcccaggttcagaaggaagcccaagcgttggtcagcgaagtactcggacagtaaaactgcggacttgctgacaa

SEQ ID NO: 26 - protein, 554 aa, Corynebacterium glutamicum
MAHERAGQLAQPEDLIDVAELVTAYFTRKPDVNNPDQQVAFGTSGHRGFALDSAFNEDHILATTQAIVDYRNQQPKNWVGPLFIGRDTHALSEPAMISALEVLIANDVEVLVDADGRYTPTPAVSHAILRHNDGIILGTAGPSRPYADGIVITPSHNPPRDGGFKYNPANGGPADTDATDWIANRANDILRGDLADVKRVPVSGVLDERTTAYDFKGIYIADLPNVVNIDAIREAGVRIGADPMGGASVDYWGAIAETHGLNLTVVNPHVDSTFRFMTLDTDGKIRMDCSSPHAMASLIDNRDKFDVATGNDADADRHGIVTPDAGLMNPNHYLAVAIEYLFAHRPGWSADTAVGKTLVSSSMIDRVVAQLGRTLVEVPVGFKWFVPGLISGEIGFGGEESAGASFLRMDGTTWSTDKDGLILDLLAAEIIAVTGKTPSQRYAELAEEFGAPAYARTDAEANREQKAILKALSPEQVTATELAGEAITAKLTEAPGNGAAIGGLKVTTENAWFAARPSGTEDKYKIYAESFKGEEHLAQVQKEAQALVSEVLGQ

SEQ ID NO: 27 - DNA, 680 bp, Corynebacterium glutamicum
  CDS (1)..(657): RXN02803
gtctctggagagatgctcgcggcagcactttcagcaggcatggccagccagggtgttgatgtcattcgtgttggtgtcatcccaaccccagctgttgcattcctcaccgatgattatggcgctgacatgggcgtgatgatttctgcatcccacaacccaatgccggacaacggaatcaagttcttttctgcaggtggacacaagcttccagaccatgtggaagacgagattgagcgtgttatggacagcttgccagcagaaggcccaacagggcatggagttggccgtgtcatcgaagaagcaaccgatgcacaggaccgttacctagagcacctgaaggaagctgttcctacgtcacttgaaggcatcaagattgttgtggatgcagccaatggtgcggcaagtgttgtagctccaacggcttatgaggctgcgggtgcaactgtaattgctattcataacaagccagactcatacaacatcaacatggactgcggttccacccacattgatcaggcgcagccgccagtcttgaagcacggtgctgaccttggactcgcgcatgacggtgatgctgaccgttgtttggctgtgaacaaggatgccaaccttgttgatggtgaccaaatcatggcgctgttagccattgcgatgaaataaaacggcgagctgcgcaagaa

SEQ ID NO: 28 - protein, 219 aa, Corynebacterium glutamicum
VSGEMLAAALSAGMASQGVDVIRVGVIPTPAVAFLTDDYGADMGVMISASHNPMPDNGIKFFSAGGHKLPDHVEDEIERVMDSLPAEGPTGHGVGRVIEEATDAQDRYLEHLKEAVPTSLEGIKIVVDAANGAASVVAPTAYEAAGATVIAIHNKPDSYNINMDCGSTHIDQAQPPVLKHGADLGLAHDGDADRCLAVNKDANLVDGDQIMALLAIAMK

SEQ ID NO: 29 - DNA, 399 bp, Corynebacterium glutamicum
  CDS (1)..(399): FRXA02803
tctggagagatgctcgcggcagcactttcagcaggcatggccagccagggtgttgatgtcattcgtgttggtgtcatcccaaccccagctgttgcattcctcaccgatgattatggcgctgacatgggcgtgatgatttctgcatcccacaacccaatgccggacaacggaatcaagttcttttctgcaggtggacacaagcttccagaccatgtggaagacgagattgagcgtgttatggacagcttgccagcagaaggcccaacagggcatggagttggccgtgtcatcgaagaagcaaccgatgcacaggaccgctacctagagcacctgaaggaagctgttcctacgtcacttgaaggcatcaagattgttgtggatgcagccaatggtgcggca

SEQ ID NO: 30 - protein, 133 aa, Corynebacterium glutamicum
SGEMLAAALSAGMASQGVDVIRVGVIPTPAVAFLTDDYGADMGVMISASHNPMPDNGIKFFSAGGHKLPDHVEDEIERVMDSLPAEGPTGHGVGRVIEEATDAQDRYLEHLKEAVPTSLEGIKIVVDAANGAA

SEQ ID NO: 31 - DNA, 1713 bp, Corynebacterium glutamicum
  CDS (101)..(1690): RXN03076
aatacctttctgttttgtccgcaggcgtatcaggaaaacctgcagcgcggtagagtcgagtctaatagtgatcccacgaaaacaaaggatcggggtgttcatggacgagtctcgtcagcttagtttcggcacagcagggttgcgtgcaccagttggcccggcgcgccatcagatgaatgttttgcaggtaaccagaactacagcaggtgttgctagttggttggcagaacgtgcggcactaaatccagtgccgcatttggttcctgaggatgaaacaggaatcggcagggcgttgtatccccaagatggtccgttgcgggtcgttgtggggtatgacgctcgctatggttcgcatacttttgctgcaaccactgcggaggtgttcgcgggtgctggttttgaggtgacgttgctccccacgcctagccctacgccgttgattccgtggttggtgaacaagcatgggttggatgcgggcgttcagatcacggcttcgcataatggtgcggcggacaatggctacaaggtgtttttgtctaatggtcgccagctttattctgaactggagcctgagcttgaggcgcatatcaatgctgtggaagatccgattcgggttcctcgggtgacggtgcgccccactgctgatcagctgcgtcgatatgttgatgagatggtgtcgttggtgactcctgatcaggctgatttgttgcgggtgaattctgagcggggcaatcttcgcgtggtgtataccgctctgcatggtgtgggtggccgcgcgatggccaatgctttccaatttgctggttttccccatactcatggcgtgaaggctcagcagtatcctgatcccaccttccccactgtggcgttccccaatccggaagagccttctgcgattgagttgttgttggaacgcgcaaaggaaaagaacgctgacattttgtttgcgcttgatcctgatgccgatcgttgtgctgtgggtattcgtaccgctgatggcggccaccgaatgctctctggcgatgaggtgggcacacttttggctactcgtttggttccggagtattccggtgaaggcccacgtcccgtggttgccaccacggtggtgtcttcgcagcttctgggtatcatcgccgaggataaagggtgggattattccgagacactgacgggattcaaaaatctgtcgagggctgccgatggtctcgacggaccgcttgctttcgcttatgaggaagctgtgggcacctgcccggttccagatgtcgtgccggataaggacggcatctctacagcgttgttcatggcgtcgtgggctgccgaactgaaggctcagggcgcaagcctgcagcaaaaactcaatgagttgtatcgccgatatgggtattttgcgtcctcgcaaattgctgtgcgcacgagcagtccacgcgagttagttgatcactggattgcgcatcctcagcaagaactcattggagtgtctgtcaccccacatattcttcctgaaaaacagggcattgctttgcatggccaggtggggcatgtgcatatccgtgctattggtcgagtctctggaactgaggcgaaagccaagctctatttggaagttggtcaggccagctcccatgatgaagcagctcagttgttgcatcagctggaggatgaagtccaaagctggttgagcaagctttagtttcctggctgctcccggtt

SEQ ID NO: 32 - protein, 530 aa, Corynebacterium glutamicum
MDESRQLSFGTAGLRAPVGPARHQMNVLQVTRTTAGVASWLAERAALNPVPHLVPEDETGIGRALYPQDGPLRVVVGYDARYGSHTFAATTAEVFAGAGFEVTLLPTPSPTPLIPWLVNKHGLDAGVQITASHNGAADNGYKVFLSNGRQLYSELEPELEAHINAVEDPIRVPRVTVRPTADQLRRYVDEMVSLVTPDQADLLRVNSERGNLRVVYTALHGVGGRAMANAFQFAGFPHTHGVKAQQYPDPTFPTVAFPNPEEPSAIELLLERAKEKNADILFALDPDADRCAVGIRTADGGHRMLSGDEVGTLLATRLVPEYSGEGPRPVVATTVVSSQLLGIIAEDKGWDYSETLTGFKNLSRAADGLDGPLAFAYEEAVGTCPVPDVVPDKDGISTALFMASWAAELKAQGASLQQKLNELYRRYGYFASSQIAVRTSSPRELVDHWIAHPQQELIGVSVTPHILPEKQGIALHGQVGHVHIRAIGRVSGTEAKAKLYLEVGQASSHDEAAQLLHQLEDEVQSWLSKL

SEQ ID NO: 33 - DNA, 1684 bp, Corynebacterium glutamicum
  CDS (101)..(1684): FRXA02854
aatacctttctgttttgtccgcaggcgtatcaggaaaacctgcagcgcggtagagtcgagtctaatagtgatcccacgaaaacaaaggatcggggtgttcatggacgagtctcgtcagcttagtttcggcacagcagggttgcgtgcaccagttggcccggcgcgccatcagatgaatgttttgcaggtaaccagaactacagcaggtgttgctagttggttggcagaacgtgcggcactaaatccagtgccgcatttggttcctgaggatgaaacaggaatcggcagggcgttgtatccccaagatggtccgttgcgggtcgttgtggggtatgacgctcgctatggttcgcatacttttgctgcaaccactgcggaggtgttcgcgggtgctggttttgaggtgacgttgctccccacgcctagccctacgccgttgattccgtggttggtgaacaagcatgggttggatgcgggcgttcagatcacggcttcgcataatggtgcggcggacaatggctacaaggtgtttttgtctaatggtcgccagctttattctgaactggagcctgagcttgaggcgcatatcaatgctgtggaagatccgattcgggttcctcgggtgacggtgcgccccactgctgatcagctgcgtcgatatgttgatgagatggtgtcgttggtgactcctgatcaggctgatttgttgcgggtgaattctgagcggggcaatcttcgcgtggtgtataccgctctgcatggtgtgggtggccgcgcgatggccaatgctttccaatttgctggttttccccatactcatggcgtgaaggctcagcagtatcctgatcccaccttccccactgtggcgttccccaatccggaagagccttctgcgattgagttgttgttggaacgcgcaaaggaaaagaacgctgacattttgtttgcgcttgatcctgatgccgatcgttgtgctgtgggtattcgtaccgctgatggcggccaccgaatgctctctggcgatgaggtgggcacacttttggctactcgtttggttccggagtattccggtgaaggcccacgtcccgtggttgccaccacggtggtgtcttcgcagcttctgggtatcatcgccgaggataaagggtgggattattccgagacactgacgggattcaaaaatctgtcgagggctgccgatggtctcgacggaccgcttgctttcgcttatgaggaagctgtgggcacctgcccggttccagatgtcgtgccggataaggacggcatctctacagcgttgttcatggcgtcgtgggctgccgaactgaaggctcagggcgcaagcctgcagcaaaaactcaatgagttgtatcgccgatatgggtattttgcgtcctcgcaaattgctgtgcgcacgagcagtccacgcgagttagttgatcactggattgcgcatcctcagcaagaactcattggagtgtctgtcaccccacatattcttcctgaaaaacagggcattgctttgcatggccaggtggggcatgtgcatatccgtgctattggtcgagtctctggaactgaggcgaaagccaagctctatttggaagttggtcaggccagctcccatgatgaagcagctcagttgttgcatcagctggaggatgaagtccaaagctggttgagc

SEQ ID NO: 34 - protein, 528 aa, Corynebacterium glutamicum
MDESRQLSFGTAGLRAPVGPARHQMNVLQVTRTTAGVASWLAERAALNPVPHLVPEDETGIGRALYPQDGPLRVVVGYDARYGSHTFAATTAEVFAGAGFEVTLLPTPSPTPLIPWLVNKHGLDAGVQITASHNGAADNGYKVFLSNGRQLYSELEPELEAHINAVEDPIRVPRVTVRPTADQLRRYVDEMVSLVTPDQADLLRVNSERGNLRVVYTALHGVGGRAMANAFQFAGFPHTHGVKAQQYPDPTFPTVAFPNPEEPSAIELLLERAKEKNADILFALDPDADRCAVGIRTADGGHRMLSGDEVGTLLATRLVPEYSGEGPRPVVATTVVSSQLLGIIAEDKGWDYSETLTGFKNLSRAADGLDGPLAFAYEEAVGTCPVPDVVPDKDGISTALFMASWAAELKAQGASLQQKLNELYRRYGYFASSQIAVRTSSPRELVDHWIAHPQQELIGVSVTPHILPEKQGIALHGQVGHVHIRAIGRVSGTEAKAKLYLEVGQASSHDEAAQLLHQLEDEVQSWLS

SEQ ID NO: 35 - DNA, 536 bp, Corynebacterium glutamicum
  CDS (1)..(513): RXA00511
gagctgcgcaagaacaccctcgtgggcactgtcatgagcaacctgggattgaagattgctatggatgaagccggaattacactgcgtaccaccaaggtaggagaccgctacgtgctggaagacctcaatgcaggtggattcagcctgggcggcgagcaatctggccacattgttcttccagatcatggcaccactggcgatggaactttgactggtctttccatcatggcgcgcatggctgaaaccggaaagtccttgggcgagttggcacaagctatgacggtgctgccacaggttctgatcaatgtgccagtttcggataagtccaccatcgtgagccacccaagcgttgtggctgcgatcgcggaagcagaagctgagttgggcgccaccggtcgcgttcttcttcgtgcttctggcaccgaagagcttttccgcgtgatggttgaggctggagacaaggaacaagctcgtcgtatcgcgggacgtcttgctgcagtggttgcagaagtctaattcacttcagtcacagcgca

SEQ ID NO: 36 - protein, 171 aa, Corynebacterium glutamicum
ELRKNTLVGTVMSNLGLKIAMDEAGITLRTTKVGDRYVLEDLNAGGFSLGGEQSGHIVLPDHGTTGDGTLTGLSIMARMAETGKSLGELAQAMTVLPQVLINVPVSDKSTIVSHPSVVAAIAEAEAELGATGRVLLRASGTEELFRVMVEAGDKEQARRIAGRLAAVVAEV

SEQ ID NO: 37 - DNA, 1497 bp, Corynebacterium glutamicum
  CDS (101)..(1474): RXN01365
cctgatcaggacgaatcataaggtttgctattcggattggatcctttggcaggggtaggattgcaagcgttattttgttccctaaccccttcgaggatttatgcgtacccgtgaatctgtcacagctgtaattaaggcgtatgacgtccgtggtgttgttggtgtcgatattgatgctgatttcatttctgagactggcgctgcctttggtcggctcatgcgtagtgagggtgaaaccaccgttgctattggccatgacatgcgtgattcctcccctgaattggccaaggcgtttgccgatggcgtgactgcacagggtttggatgttgttcatttgggactgacttctactgatgagctgtactttgcgtccggaaccttgaagtgtgctggtgcgatgtttactgcgtcgcataaccccgctgagtacaacggcatcaagttgtgtcgtgcgggtgctcgtccggtcggtcaggattctggtttggccaacatcattgatgatctggttgagggtgttccagcgtttgatggtgagtcaggttcggtttctgagcaggatttgctgagcgcatatgccgagtacctcaatgagcttgttgatctgaagaacatccgcccgatgaaggttgctgtggatgcggcaaacggcatgggtgggttcactgtccctgaggtattcaagggtctgccacttgatgttgcgccactgtattttgagcttgacggcaatttccccaaccatgaggccaatcctctggagcctgccaacctggttgatttgcagaagtttaccgtagagaccggatctgatatcggtttggcgttcgacggcgatgcggatcgttgcttcgtggtcgatgagaagggccagccagtcagcccttcggcgatctgtgcgatcgtagcggagcgttacttggagaagcttccgggttccaccatcatccacaacctgattacctctaaggctgtgcctgaggtgattgctgaaaacggtggcactgcggtgcgtactcgcgtgggtcactccttcatcaaggcgaagatggcagagaccggtgcggcctttggtggcgagcactctgcgcactactacttcactgagttcttcaatgcggactccggcattttggctgcgatgcacgtgctggctgcgctgggaagccaggaccagccactcagtgagatgatggctaggtataaccggtacgttgcttcaggcgagttgaactcccgtttggctaatgcagaggcgcagcaagagcgcacccaggctgtgctcgatgcgttcgctgatcgcaccgagtccgtggacacccttgacggcgtgactgtggaactcaaggacacctccgcgtggttcaacgtgcgtgcgtccaacaccgagccgctgcttcgcctcaatgttgaagctgcatcgaaggaagaagtcgatgcgttggtagcggagattctagggattatccgcgcataatcccattttccggcgggcat

SEQ ID NO: 38 - protein, 458 aa, Corynebacterium glutamicum
MRTRESVTAVIKAYDVRGVVGVDIDADFISETGAAFGRLMRSEGETTVAIGHDMRDSSPELAKAFADGVTAQGLDVVHLGLTSTDELYFASGTLKCAGAMFTASHNPAEYNGIKLCRAGARPVGQDSGLANIIDDLVEGVPAFDGESGSVSEQDLLSAYAEYLNELVDLKNIRPMKVAVDAANGMGGFTVPEVFKGLPLDVAPLYFELDGNFPNHEANPLEPANLVDLQKFTVETGSDIGLAFDGDADRCFVVDEKGQPVSPSAICAIVAERYLEKLPGSTIIHNLITSKAVPEVIAENGGTAVRTRVGHSFIKAKMAETGAAFGGEHSAHYYFTEFFNADSGILAAMHVLAALGSQDQPLSEMMARYNRYVASGELNSRLANAEAQQERTQAVLDAFADRTESVDTLDGVTVELKDTSAWFNVRASNTEPLLRLNVEAASKEEVDALVAEILGIIRA

SEQ ID NO: 39 - DNA, 994 bp, Corynebacterium glutamicum
  CDS (101)..(994): FRXA01365
cctgatcaggacgaatcataaggtttgctattcggattggatcctttggcaggggtaggattgcaagcgttattttgttccctaaccccttcgaggatttatgcgtacccgtgaatctgtcacagctgtaattaaggcgtatgacgtccgtggtgttgttggtgtcgatattgatgctgatttcatttctgagactggcgctgcctttggtcggctcatgcgtagtgagggtgaaaccaccgttgctattggccatgacatgcgtgattcctcccctgaattggccaaggcgtttgccgatggcgtgactgcacagggtttggatgttgttcatttgggactgacttctactgatgagctgtactttgcgtccggaaccttgaagtgtgctggtgcgatgtttactgcgtcgcataaccccgctgagtacaacggcatcaagttgtgtcgtgcgggtgctcgtccggtcggtcaggattctggtttggccaacatcattgatgatctggttgagggtgttccagcgtttgatggtgagtcaggttcggtttctgagcaggatttgctgagcgcatatgccgagtacctcaatgagcttgttgatctgaagaacatccgcccgatgaaggttgctgtggatgcggcaaacggcatgggtgggttcactgtccctgaggtattcaagggtctgccacttgatgttgcgccactgtattttgagcttgacggcaatttccccaaccatgaggccaatcctctggagcctgccaacctggttgatttgcagaagtttaccgtagagaccggatctgatatcggtttggcgttcgacggcgatgcggatcgttgcttcgtggtcgatgagaagggccagccagtcagcccttcggcgatctgtgcgatcgtagcggagcgttacttggagaagcttccgggttccaccatcatccacaacctgattacctctaaggctgtgcctgaggtgattgctgaa

SEQ ID NO: 40 - protein, 298 aa, Corynebacterium glutamicum
MRTRESVTAVIKAYDVRGVVGVDIDADFISETGAAFGRLMRSEGETTVAIGHDMRDSSPELAKAFADGVTAQGLDVVHLGLTSTDELYFASGTLKCAGAMFTASHNPAEYNGIKLCRAGARPVGQDSGLANIIDDLVEGVPAFDGESGSVSEQDLLSAYAEYLNELVDLKNIRPMKVAVDAANGMGGFTVPEVFKGLPLDVAPLYFELDGNFPNHEANPLEPANLVDLQKFTVETGSDIGLAFDGDADRCFVVDEKGQPVSPSAICAIVAERYLEKLPGSTIIHNLITSKAVPEVIAE

SEQ ID NO: 41 - DNA, 1743 bp, Corynebacterium glutamicum
  CDS (101)..(1720): RXA00098
taaatttgtcgtgtttcccactttgaacactcttcgatgcgcttggccacaaaagcaagctaacctgaagatgttatttaacgacaataaaggagttttcatggcggacatttcgaccacccaggtttggcaagacctgaccgatcattactcaaacttccaggcaaccactctgcgtgaacttttcaaggaagaaaaccgcgccgagaagtacaccttctccgcggctggcctccacgtcgacctgtcgaagaatctgcttgacgacgccaccctcaccaagctccttgcactgaccgaagaatctggccttcgcgaacgcattgacgcgatgtttgccggtgaacacctcaacaacaccgaagaccgcgctgtcctccacaccgcgctgcgccttcctgccgaagctgatctgtcagtagatggccaagatgttgctgctgatgtccacgaagttttgggacgcatgcgtgacttcgctactgcgctgcgctcaggcaactggttgggacacaccggccacacgatcaagaagatcgtcaacattggtatcggtggctctgacctcggaccagccatggctacgaaggctctgcgtgcatacgcgaccgctggtatctcagcagaattcgtctccaacgtcgacccagcagacctcgtttctgtgttggaagacctcgatgcagaatccacattgttcgtgatcgcttcgaaaactttcaccacccaggagacgctgtccaacgctcgtgcagctcgtgcttggctggtagagaagctcggtgaagaggctgtcgcgaagcacttcgtcgcagtgtccaccaatgctgaaaaggtcgcagagttcggtatcgacacggacaacatgttcggcttctgggactgggtcggaggtcgttactccgtggactccgcagttggtctttccctcatggcagtgatcggccctcgcgacttcatgcgtttcctcggtggattccacgcgatggatgaacacttccgcaccaccaagttcgaagagaacgttccaatcttgatggctctgctcggtgtctggtactccgatttctatggtgcagaaacccacgctgtcctaccttattccgaggatctcagccgttttgctgcttacctccagcagctgaccatggaatcaaatggcaagtcagtccaccgcgacggctcccctgtttccactggcactggcgaaatttactggggtgagcctggcacaaatggccagcacgctttcttccagctgatccaccagggcactcgccttgttccagctgatttcattggtttcgctcgtccaaagcaggatcttcctgccggtgagcgcaccatgcatgaccttttgatgagcaacttcttcgcacagaccaaggttttggctttcggtaagaacgctgaagagatcgctgcggaaggtgtcgcacctgagctggtcaaccacaaggtcatgccaggtaatcgcccaaccaccaccattttggcggaggaacttaccccttctattctcggtgcgttgatcgctttgtacgaacacatcgtgatggttcagggcgtgatttgggacatcaactccttcgaccaatggggtgttgaactgggcaaacagcaggcaaatgacctcgctccggctgtctctggtgaagaggatgttgactcgggagattcttccactgattcactgattaagtggtaccgcgcaaataggtagtcgcttgcttatagggtcag

SEQ ID NO: 42 - protein, 540 aa, Corynebacterium glutamicum
MADISTTQVWQDLTDHYSNFQATTLRELFKEENRAEKYTFSAAGLHVDLSKNLLDDATLTKLLALTEESGLRERIDAMFAGEHLNNTEDRAVLHTALRLPAEADLSVDGQDVAADVHEVLGRMRDFATALRSGNWLGHTGHTIKKIVNIGIGGSDLGPAMATKALRAYATAGISAEFVSNVDPADLVSVLEDLDAESTLFVIASKTFTTQETLSNARAARAWLVEKLGEEAVAKHFVAVSTNAEKVAEFGIDTDNMFGFWDWVGGRYSVDSAVGLSLMAVIGPRDFMRFLGGFHAMDEHFRTTKFEENVPILMALLGVWYSDFYGAETHAVLPYSEDLSRFAAYLQQLTMESNGKSVHRDGSPVSTGTGEIYWGEPGTNGQHAFFQLIHQGTRLVPADFIGFARPKQDLPAGERTMHDLLMSNFFAQTKVLAFGKNAEEIAAEGVAPELVNHKVMPGNRPTTTILAEELTPSILGALIALYEHIVMVQGVIWDINSFDQWGVELGKQQANDLAPAVSGEEDVDSGDSSTDSLIKWYRANR

SEQ ID NO: 43 - DNA, 630 bp, Corynebacterium glutamicum
  CDS (1)..(630): RXA01989
gttaaatcaattcacaaaacaattcatgaaggtactggtgcaggtagtgacttcttaggctgggttgatttaccagttgattacgacaaagaagaattttcaagaattgttgaagcatcaaaacgcattaaagaaaattctgatgttttagtagtcatcggtattggtggttcttacttaggtgcacgtgcagcaatcgaaatgttaacgtcatcatttagaaacagcaatgaataccctgaaattgtatttgttggtaatcacttatcatcaacatatacgaaagagttagttgattatttagcagacaaagatttctctgtaaacgttatttctaaatctggtacaactacagaaccagcagttgcatttagattgttcaaacaattagttgaagaaagatacggtaaagaagaagcacaaaaacgtatatttgcaacaacggataaagaaaaaggtgctttaaaacagttggctacaaacgaaggttatgaaacgtttatcgtacctgatgatgtaggtggaagatattctgttttaacagcagtaggattattaccaattgcaacagctggaattaacatcgaagctatgatgattggtgctgcaaaagcacgtgaagaattatct

SEQ ID NO: 44 - protein, 210 aa, Corynebacterium glutamicum
VKSIHKTIHEGTGAGSDFLGWVDLPVDYDKEEFSRIVEASKRIKENSDVLVVIGIGGSYLGARAAIEMLTSSFRNSNEYPEIVFVGNHLSSTYTKELVDYLADKDFSVNVISKSGTTTEPAVAFRLFKQLVEERYGKEEAQKRIFATTDKEKGALKQLATNEGYETFIVPDDVGGRYSVLTAVGLLPIATAGINIEAMMIGAAKAREELS

SEQ ID NO: 45 - DNA, 1269 bp, Corynebacterium glutamicum
  CDS (101)..(1246): RXA00340
cggtatctccgacatccgcaacacccccaaagatgaggttccacagtgcccagaatgtggctcttacctcatcactgacatctcttagaaagaccacccagtgaaattagtcatcgaggccgacggcggctcccgcggaaaccccggcgtcgccggctccggcaccgtggtgtactccgacaacaaagcagaagttctcaaagaaatcgcctatgttgtcggaacaaaagccaccaacaacgtcgccgaataccgcggactactcgaaggcctcaaagcagcccgcgagctcggcgctacctccgtggatgtctacatggactccaaacttgtcgttgaacaaatgtccggccggtggaaaatcaaacaccccgacatgaaagttctagcgatcgaagccaaggagattgcttccgaaatcgggtccgtttcttatacgtggattccgcgtgagaaaaacaaacgagctgacgcattgtccaacgtggcgatggatgctgcagcggcaggtaagccggtaggtgttgtaggggattctgcttctgtatcttctgcttcttcggttgcgggctcagagaaagaagacctcaactgcaccgaaaccaaacccaccaactggaacggcgcaaccacagatcccactcgtttcttgttgcttcgccacggccaaactgctatgtcagtggcacgcctttactccggtaggtccaacccagagctgtctgaacttggtgaaaaacaagcagcagcggcagcacgacgactcgctcaaaccggtggcatcgacgctattgtgagttctccgctcacccgcacgatgcaaaccgcagaagcagcagcggccgcactgggaatgaaagtacgtgttatcgatgatctcatcgaaactgactttggactgtgggatggaaaatcattttcagaagcccacgaacaagatccagaactgcacaccaagtggctcactgactcatctgtagccccacccggtggtgagtccctgcagacggttaatcgacgtgtgaaaaaggctcgtgaaagcctccaacgcgaatacggtgcagcgaatgttttggtggtcagccacgtcaccccaatcaaagccatcatgaggcaagcattggacgcaggcccatccttctttcagaaggcacaccttgacttggcgtcgctgtcgatcgcagagttttacgaagacggcccaacctgcgtaagactgttcaacgacacctcacacctggaagcgtgacgacagtctgacggaagctc

SEQ ID NO: 46 - protein, 382 aa, Corynebacterium glutamicum
VKLVIEADGGSRGNPGVAGSGTVVYSDNKAEVLKEIAYVVGTKATNNVAEYRGLLEGLKAARELGATSVDVYMDSKLVVEQMSGRWKIKHPDMKVLAIEAKEIASEIGSVSYTWIPREKNKRADALSNVAMDAAAAGKPVGVVGDSASVSSASSVAGSEKEDLNCTETKPTNWNGATTDPTRFLLLRHGQTAMSVARLYSGRSNPELSELGEKQAAAAARRLAQTGGIDAIVSSPLTRTMQTAEAAAAALGMKVRVIDDLIETDFGLWDGKSFSEAHEQDPELHTKWLTDSSVAPPGGESLQTVNRRVKKARESLQREYGAANVLVVSHVTPIKAIMRQALDAGPSFFQKAHLDLASLSIAEFYEDGPTCVRLFNDTSHLEA

SEQ ID NO: 47 - DNA, 840 bp, Corynebacterium glutamicum
  CDS (101)..(817): RXA02492
gctgtacaacgacgctattgccaacgaaaatgtcgacggtgaaacgcatcacggctaagtaaacgcgcgtcgtggaacataaagtggcaaactagtacctatgactaacggaaaattgattcttcttcgtcacggtcagagcgaatggaacgcatccaaccagttcactggatgggtcgacgtcaatctgaccgaacagggtgaggctgaggccaaaggcgtcctcccaggcgttgtatacacctccttgctgcgtcgcgcgatccgcactgcaaacatcgcactgaacgctgcagaccgccactggatcccagtgatccgcgactggcgcctcaacgagcgtcactacggcgcactgcagggccttgacaaggctgcaaccaaggaaaaatacggcgacgaccagttcatggaatggcgccgctcctacgacaccccaccaccagagctcgcggatgacgcagagtactcccaggcaaatgaccctcgttacgcggacctcgacgtagttccacgcaccgaatgcctcaaggacgttgtggttcgttttgttccttacttcgaggaagaaatcctgccacgcgcaaagaagggcgaaaccgtcctcatcgcagcacacggcaactccctgcgtgcgctggttaagcaccttgacggcatctccgatgctgatatcgcagagctcaacatcccaaccggcatcccactggtctacgaaatcgccgaagacggttccgtagtaaacccaggcggcacctacctcgatcctgaggcagcagcagccggcgcagcagcagtagcaaaccagggtaataagtagctatttgtaggtgagcactc

SEQ ID NO: 48 - protein, 239 aa, Corynebacterium glutamicum
MTNGKLILLRHGQSEWNASNQFTGWVDVNLTEQGEAEAKGVLPGVVYTSLLRRAIRTANIALNAADRHWIPVIRDWRLNERHYGALQGLDKAATKEKYGDDQFMEWRRSYDTPPPELADDAEYSQANDPRYADLDVVPRTECLKDVVVRFVPYFEEEILPRAKKGETVLIAAHGNSLRALVKHLDGISDADIAELNIPTGIPLVYEIAEDGSVVNPGGTYLDPEAAAAGAAAVANQGNK

SEQ ID NO: 49 - DNA, 729 bp, Corynebacterium glutamicum
  CDS (101)..(706): RXA00381
aaacctggtttgtgtcttccgctctcacggacgatgatttctccaagatcgagcaggcactcaagcccgccgcacgtgcagcagcagaagcgaaggcatcatgacgcaaaccattgtccatctagttcgccacggcgaagtccacaacccagagaaaatcctgtacggacgcatgcccggatacaggttgtcttcccgtggacgcagccaagccgcccgcactgcagcttcttttgaaggccacgatgtcacctacattgcggcctccccattgcagcgtgtgcaggaaacctccgaaccgttcatcaaggtcacaggcctagaactgatcaccgacgaggatcttctggaagcaggcaaccgtttcgaaggcctgcgcaccaaaggttggcgttcccagttgtggaaccccgtgcgttggcctttgatgtacaaccccacgcttcccagctggggcgaacactacaccgacattttggaaagaatgatggcggctgtggaacgagctcgggtggcagcggaaggacacgaagcaatcctggtgacccaccagttgccgatcgtgtgcgtgcaacgccacgcccgcggacaaagcctgtcccataacccagcgaccaggcaatgcgacctcgcctcagtgacatccttggtgttccaagacgatcaaattgtcggcgtgcattacaacgaaccagctcaggagatttgatcactcgtgcgtttgaccaa

SEQ ID NO: 50 - protein, 202 aa, Corynebacterium glutamicum
MTQTIVHLVRHGEVHNPEKILYGRMPGYRLSSRGRSQAARTAASFEGHDVTYIAASPLQRVQETSEPFIKVTGLELITDEDLLEAGNRFEGLRTKGWRSQLWNPVRWPLMYNPTLPSWGEHYTDILERMMAAVERARVAAEGHEAILVTHQLPIVCVQRHARGQSLSHNPATRQCDLASVTSLVFQDDQIVGVHYNEPAQEI

SEQ ID NO: 51 - DNA, 822 bp, Corynebacterium glutamicum
  CDS (101)..(799): RXA02122
ggccttcagctcaccgacagtttgtacatttggtggaagactcacaccccacaccctagacctttttttaagtgggcggtcaggaatttttcgcacaggtatgctgcatgtcatgaagccgggttcacacgcagctgccgaaaagactcaatccactgtggttttactcattcggcatgggcaaaccccaacaactggtcaggttctgcctggtcagacgccgggtttacacctgtctgataagggtgaagagcaggcgcgggaggtggcacagcgtctggcggaggtgccgattaccgctgtgtattcatcgccgatggagcgtgcgcaggaaacagcagcaccgacggtcagcgctcatggcctcgagttgacggtggaacctgggcttattgaatgcgatttcggcgagtggacgggccggaaactaactgagctcaatgccctagaggagtggaaagcggtgcagaagacaccgtctaccttcaggtttccaggtggtgagagtttcgtggaaatgcaggatcggatggtggaggctatcggcaacattgcgcagcagcatccgggagaaatcgttgctgcgtttagtcatgccgacacgatcaaggctgcggtggctcattttgtaggcactccactggattcttttcagcgcattttcatcgacacggcgtcaatttccgcagtggaatttaccgggaaatcttcaggcgtctcctcccatatgctgctgacaaattccagaacaggatcgttgggataccttcgagacaaacttccgaaagctccgcaaccatgatcacctcaccatttgagcgc

SEQ ID NO: 52 - protein, 233 aa, Corynebacterium glutamicum
MLHVMKPGSHAAAEKTQSTVVLLIRHGQTPTTGQVLPGQTPGLHLSDKGEEQAREVAQRLAEVPITAVYSSPMERAQETAAPTVSAHGLELTVEPGLIECDFGEWTGRKLTELNALEEWKAVQKTPSTFRFPGGESFVEMQDRMVEAIGNIAQQHPGEIVAAFSHADTIKAAVAHFVGTPLDSFQRIFIDTASISAVEFTGKSSGVSSHMLLTNSRTGSLGYLRDKLPKAPQP

SEQ ID NO: 53 - DNA, 1161 bp, Corynebacterium glutamicum
  CDS (101)..(1138): RXA00206
ttaaataagatggtcagagacagttttttggcctgtcaacccctgtgattctcttatttttgggtgattgttccggcgcgggtgttgtgatgggtttaatatggaagacatgcgaattgctactctcacgtcaggcggcgactgccccggactaaacgccgtcatccgaggaatcgtccgcacagccagcaatgaatttggctccaccgtcgttggttatcaagacggttgggaaggactgttaggcgatcgtcgcgtacagctgtatgacgatgaagatattgaccgaatcctccttcgaggcggcaccattttgggcactggtcgcctccatccggacaagtttaaggccggaattgatcagattaaggccaacttagaagacgccggcatcgatgcccttatcccaatcggtggcgaaggaaccctgaagggtgccaagtggctgtctgataacggtatccctgttgtcggtgtcccaaagaccattgacaatgacgtgaatggcactgacttcaccttcggtttcgatactgctgtggcagtggctaccgacgctgttgaccgcctgcacaccaccgctgaatctcacaaccgtgtgatgatcgtggaggtcatgggccgccacgtgggttggattgctctgcacgcaggtatggccggcggtgctcactacaccgttattccagaagtacctttcgatattgcagagatctgcaaggcgatggaacgtcgcttccagatgggcgagaagtacggcattatcgtcgttgcggaaggtgcgttgccacgcgaaggcaccatggagcttcgtgaaggccacattgaccagttcggtcacaagaccttcacgggaattggacagcagatcgctgatgagatccacgtgcgcctcggccacgatgttcgtacgaccgttcttggccacattcaacgtggtggaaccccaactgctttcgaccgtgttctggccactcgttatggtgttcgtgcagctcgtgcgtgccatgagggaagctttgacaaggttgttgctttgaagggtgagagcattgagatgatcacctttgaagaagcagtcggaaccttgaaggaagttccattcgaacgctgggttactgcccaggcaatgtttggatagtttttcgggcttttatcaac

SEQ ID NO: 54 - protein, 346 aa, Corynebacterium glutamicum
MEDMRIATLTSGGDCPGLNAVIRGIVRTASNEFGSTVVGYQDGWEGLLGDRRVQLYDDEDIDRILLRGGTILGTGRLHPDKFKAGIDQIKANLEDAGIDALIPIGGEGTLKGAKWLSDNGIPVVGVPKTIDNDVNGTDFTFGFDTAVAVATDAVDRLHTTAESHNRVMIVEVMGRHVGWIALHAGMAGGAHYTVIPEVPFDIAEICKAMERRFQMGEKYGIIVVAEGALPREGTMELREGHIDQFGHKTFTGIGQQIADEIHVRLGHDVRTTVLGHIQRGGTPTAFDRVLATRYGVRAARACHEGSFDKVVALKGESIEMITFEEAVGTLKEVPFERWVTAQAMFG

SEQ ID NO: 55 - DNA, 1083 bp, Corynebacterium glutamicum
  CDS (101)..(1060): RXA01243
gcgcaatcagcgatatcgatgtggtggtcaccgatgcgggtgcaccagcaagtttcgttgagcagttgcgagaacgcgatgtagaagttgtgattgcagaatgattcttacagtcactgcaagtccgtatctgttgagcaccaatgagcttgacggcaccatcgaaattggcgaagcaaacaaaatccggcaggtttccactgttgccggtggttttggcaccggtgtggctgccaccttgttttatggcggcaatgaaacttttgcagtttttcccgctccagaaatctctcattacatgcgcctggtgacgtttgctgggttgcctcatgaaattattccggtggcaggtcccatccccatgcatttgaccatgcgtgatgcagagggcaatgagactaagttcaaagactcccccatgcctttggatgtgtcccagttggcaattcttcgtgatctagtggtgcgtcgagccgaagatgccgcgtgggtgttgttgggtggcaatttgccgtctatcgcgcctgctgcgtggtttgtggatgtggtgagatcacttcgcttgtaccaccctcatgtgaaggtagctatcgcagcaactggtgctgcgttgcgtgcggttattcgacagcttgcagctacgtccccggatgcgctgattgtggctgcggaagaaatcgaaattgccactggattagaacccaaaaccttgagaggtccatgggtagagggagatctctccccgactgtggcggcagcgcgcgctttaattgatagcggtgtcaccgaggtgttggttaccaacaagcggacggaatctttgtatgtttccgagtctgaatcactgttagccagctacgacagcacccctggtaagcagggcgtgaattggcgggaatcttttactgcaggattcttggcagcatccaatgatggaaaatccactgaggacagcgtgatcaacgcggttgcttacgccaacgctgaaggcagtgagtgggacaactacattcccacacccgataagcttcgggcggagcacgtggtcatcaaatcgctttagaccacgcaaaaagcctcaaa

SEQ ID NO: 56 - protein, 320 aa, Corynebacterium glutamicum
MILTVTASPYLLSTNELDGTIEIGEANKIRQVSTVAGGFGTGVAATLFYGGNETFAVFPAPEISHYMRLVTFAGLPHEIIPVAGPIPMHLTMRDAEGNETKFKDSPMPLDVSQLAILRDLVVRRAEDAAWVLLGGNLPSIAPAAWFVDVVRSLRLYHPHVKVAIAATGAALRAVIRQLAATSPDALIVAAEEIEIATGLEPKTLRGPWVEGDLSPTVAAARALIDSGVTEVLVTNKRTESLYVSESESLLASYDSTPGKQGVNWRESFTAGFLAASNDGKSTEDSVINAVAYANAEGSEWDNYIPTPDKLRAEHVVIKSL

SEQ ID NO: 57 - DNA, 1113 bp, Corynebacterium glutamicum
  CDS (101)..(1090): RXA01882
accctttttccaccttggctgattttgatgcccttgttaccgatgaccacacgctagattttccagttttgcccgaccacaactttcaggtggtaaccccatgatcatcacattcaccccaaacccgagtattgattccacgctgtcgctcggcgaagagctctcccgtggatccgtccaacgacttgattccgtcaccgctgtcgcaggtggtaaaggcatcaatgtcgcccacgctgtcttgcttgcgggctttgaaaccttggctgtgttcccagccggcaagctcgaccccttcgtcccactggtccgcgacatcggcttgcccgtggaaactgttgtgatcaacaagaacgtccgcaccaacaccacagtcaccgaaccggacggcaccaccaccaagctcaacggccccggcgcgccgctcagcgagcagaagctccgtagcttggaaaaggtgcttatcgacgcgctccgccccgaagtcacctgggttgtcctggcgggctcgctgccaccaggggcaccagttgactggtacgcgcgtctcaccgcgttgatccattcagcacgccctgacgttcgcgtggctgtcgatacctcagacaagccactgatggcgttgggcgagagcttggatacacctggcgctgctccgaacctgattaagccaaatggtctggaactgggccagctggctaacactgatggtgaagagctggaggcgcgtgctgcgcaaggcgattacgacgccatcatcgcagctgcggacgtactggttaaccgtggcatcgaacaggtgcttgtcaccttgggtgccgcaggagcggtgttggtcaacgcagaaggtgcgtggactgctacttctccaaagattgatgttgtatccaccgttggagctggagactgtgctcttgcaggttttgttatggcacgttcccagaagaaaacactggaggaatctctgctgaatgccgtgtcttacggctcgactgcggcgtctcttcctggcactaccattcctcgtcctgaccaactcgccacagctggtgcaacggtcacccaagtcaaaggattgaaagaatcagcatgaatagcgtaaataattcctcg

SEQ ID NO: 58 - protein, 330 aa, Corynebacterium glutamicum
MIITFTPNPSIDSTLSLGEELSRGSVQRLDSVTAVAGGKGINVAHAVLLAGFETLAVFPAGKLDPFVPLVRDIGLPVETVVINKNVRTNTTVTEPDGTTTKLNGPGAPLSEQKLRSLEKVLIDALRPEVTWVVLAGSLPPGAPVDWYARLTALIHSARPDVRVAVDTSDKPLMALGESLDTPGAAPNLIKPNGLELGQLANTDGEELEARAAQGDYDAIIAAADVLVNRGIEQVLVTLGAAGAVLVNAEGAWTATSPKIDVVSTVGAGDCALAGFVMARSQKKTLEESLLNAVSYGSTAASLPGTTIPRPDQLATAGATVTQVKGLKESA

SEQ ID NO: 59 - DNA, 1155 bp, Corynebacterium glutamicum
  CDS (101)..(1132): RXA01702
attgtgaatgtgggattatcggttcgcgcttcaccatgtttctgcatgatgaaattacatacatagttcagtgacagtcaccttttggaggagacaccttatgcctatcgcaactcccgaggtctataacgagatgctcgatcgtgctaaggaaggcggattcgccttcccagccatcaactgcacctcctcggaaaccatcaacgcagctctcaagggcttcgcagaggctgaatctgacggaatcatccagttctccaccggtggtgcagagttcggttccggcctggcagtaaagaacaaggtcaagggcgcagttgcgcttgcagccttcgcccacgaggcagcaaagagctacggcatcaacgttgctctgcacactgaccactgccagaaggaagtcctggacgagtacgtccgcccactgctggctatctcccaggagcgcgtcgaccgcggcgagcttccactgttccagtcccacatgtgggatggttccgctgtcccaatcgacgagaacctcgaaatcgcacaggagctgctggctaaggccaaggcagcgaacatcatcttggaagttgagatcggtgttgtcggtggcgaagaagacggcgttgaggctaaggctggcgcaaacctctacacctccccagaagactttgagaagaccatcgatgcaatcggcaccggtgagaagggccgctacctgctagcagctaccttcggtaacgtccacggcgtttacaagccaggcaacgtcaagctgcgcccagaggtcctccttgagggccagcaggttgcacgcaagaagcttggacttgcagacgacgcacttccattcgacttcgtcttccacggtggctcaggctccgagaaggaaaagatcgaagaggcgctgacctacggcgtcatcaagatgaacgttgatactgacacccagtacgcattcacccgcccaatcgtctcccacatgtttgagaactacaacggcgttctcaagatcgacggcgaggtcggaaacaagaaggcttacgacccacgctcttacatgaagaaggctgagcagagcatgtctgagcgcattatcgagtcttgccaggacctcaagtctgttggaaagaccacctctaagtaatctcagcagttaaaaagggc

SEQ ID NO: 60 - protein, 344 aa, Corynebacterium glutamicum
MPIATPEVYNEMLDRAKEGGFAFPAINCTSSETINAALKGFAEAESDGIIQFSTGGAEFGSGLAVKNKVKGAVALAAFAHEAAKSYGINVALHTDHCQKEVLDEYVRPLLAISQERVDRGELPLFQSHMWDGSAVPIDENLEIAQELLAKAKAANIILEVEIGVVGGEEDGVEAKAGANLYTSPEDFEKTIDAIGTGEKGRYLLAATFGNVHGVYKPGNVKLRPEVLLEGQQVARKKLGLADDALPFDFVFHGGSGSEKEKIEEALTYGVIKMNVDTDTQYAFTRPIVSHMFENYNGVLKIDGEVGNKKAYDPRSYMKKAEQSMSERIIESCQDLKSVGKTTSK

SEQ ID NO: 61 - DNA, 900 bp, Corynebacterium glutamicum
  CDS (101)..(877): RXA02258
cgttgcaattctcgctcagtaaatccgacacggccctttgttagaaaacaaaacataaagggccaccgggaaacttttttaagaaaggtgtgtttcacacatggcacgtaagccacttatcgctggtaactggaagatgaacctggatcaccagcaggcaatcggcactgttcagaagcttgcattcgcccttccaaaggaatacttcgagaaggttgacgttgcagtcaccgttcctttcactgacatccgctccgtccagactctcgttgagggcgacaagcttgaggtcactttcggtgctcaggacgtctcccagcacgagtccggtgcgtacaccggtgaagtttctgcaagcatgctggcaaagttgaactgctcttgggttgtcgttggacactccgagcgccgcgagtaccacaacgagtctgatgagttggttgctgcgaaggcaaaggcagctctgtccaacggcatcagcccgatcgtctgcgttggtgagccactggaaatccgtgaagctggcacccacgttgagtacgtcgtcgagcagacccgtaagtcccttgctggcctggatgctgctgagctggccaacaccgttatcgcgtatgagccagtgtgggctatcggcaccggtaaggttgcttccgcagctgacgctcaggaagtgtgcaaggctatccgcggtctgatcgtggagcttgcaggcgacgaggtcgctgagggcctgcgtattctttacggtggttctgttaaggcagaaaccgtcgctgagatcgtcggtcagcctgacgtcgacggcggacttgtcggtggcgcttccctcgacggtgaagcattcgccaagctggctgccaacgctgcgagcgttgcttaaagtacagagctttaaagcac

SEQ ID NO: 62 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 63 - DNA, 1563 bp, Corynebacterium glutamicum
  CDS (101)..(1540): RXN01225
tttgggctaatgttggggggagtgctttcaactatccacgagagctgcccagtgataaaccccgggttaaccccacgcctaagtcagtgaaggactttttatgacgcacaaccacaaggactggaacgatcgcattgcagttgcggaggaaatggtgccgttgatcgggcgcctgcaccgcaacaacaacgtggtggtttccgtattcggtcgtctccttgtgaatgtctcagacatcgatatcatcaagtctcaccgctacgcccgccacatcatatccaaggaacttccactggaaagctccttggatattttgcgcgaactggtagatatgaaccttggtaccgcatcgatcgacctgggacagctggcctacagcttcgaagaatccgaaagcaccgacctgcgtgccttcctggaggacgctctcgcgccggtcattggtgcggaaaccgacatcaacccaactgatatcgtgctgtacggtttcggccgcatcggtcgcctgctggcccgcatcctggtttcccgcgaggcactgtatgacggtgctcgtctgcgcgccatcgtggtccgcaaaaatggtgaagaagacctggtcaagcgcgcatccttgctgcgtcgtgattctgtccacggtggattcgatggcaccatcaccaccgattatgacaacaacatcatctgggccaacggcaccccaatcaaggtcatctactccaatgacccagccaccattgattacaccgaatacggcatcaatgacgccgtcgtggtagacaacaccggccgctggcgtgaccgcgaaggcctgtcccagcacctcaagtccaagggcgttgccaaggttgtactcaccgcgccgggcaagggcgatctgaagaacatcgtgtacggcatcaaccacaccgacatcaccgcagatgatcagatcgtttccgcagcatcatgcaccaccaatgccattaccccagtgctcaaggtgatcaatgatcgctacggcgtggaattcggccacgtagaaaccgttcactccttcaccaatgaccagaacctgatcgacaacttccacaagggttctcgccgtggtcgcgcagcaggtctgaatatggttctcaccgaaaccggcgctgcaaaggctgtatccaaggcgcttccagagctggaaggcaagctcaccggcaatgccatccgcgttcctacccctgacgtgtccatggctgtgctcaacttgaccctgaacacggaggtggaccgcgatgaggtcaacgagttcctccgccgtgtgtccctgcactctgacttgcgccagcaaatcgactggatccgttccccagaggttgtttccactgacttcgtgggcaccacccacgcgggcatcgttgatggtctagccaccatcgcaaccggtcgccacctggtgctttacgtgtggtacgacaacgagttcggctactccaaccaggtcattcgcatcgtcgaggagatcgccggcgtgcgtcctcgcgtgtacccggagcgcaggcagccagccgtactataggttatccaagcctaatacac

SEQ ID NO: 64 - protein, 480 aa, Corynebacterium glutamicum
MTHNHKDWNDRIAVAEEMVPLIGRLHRNNNVVVSVFGRLLVNVSDIDIIKSHRYARHIISKELPLESSLDILRELVDMNLGTASIDLGQLAYSFEESESTDLRAFLEDALAPVIGAETDINPTDIVLYGFGRIGRLLARILVSREALYDGARLRAIVVRKNGEEDLVKRASLLRRDSVHGGFDGTITTDYDNNIIWANGTPIKVIYSNDPATIDYTEYGINDAVVVDNTGRWRDREGLSQHLKSKGVAKVVLTAPGKGDLKNIVYGINHTDITADDQIVSAASCTTNAITPVLKVINDRYGVEFGHVETVHSFTNDQNLIDNFHKGSRRGRAAGLNMVLTETGAAKAVSKALPELEGKLTGNAIRVPTPDVSMAVLNLTLNTEVDRDEVNEFLRRVSLHSDLRQQIDWIRSPEVVSTDFVGTTHAGIVDGLATIATGRHLVLYVWYDNEFGYSNQVIRIVEEIAGVRPRVYPERRQPAVL

SEQ ID NO: 65 - DNA, 1563 bp, Corynebacterium glutamicum; identical to SEQ ID NO: 63
  CDS (101)..(1540): FRXA01225

SEQ ID NO: 66 - protein, 480 aa, Corynebacterium glutamicum; identical to SEQ ID NO: 64

SEQ ID NO: 67 - DNA, 1125 bp, Corynebacterium glutamicum
  CDS (101)..(1102): RXA02256
ttgggttctgtcagctcaagaattcttgagtgaccgatgctctgattgacctaactgcttgacacattgcatttcctacaatctttagaggagacacaacatgaccattcgtgttggtattaacggatttggccgtatcggacgtaacttcttccgcgcagttctggagcgcagcgacgatctcgaggtagttgcagtcaacgacctcaccgacaacaagaccctttccacccttctcaagttcgactccatcatgggccgccttggccaggaagttgaatacgacgatgactccatcaccgttggtggcaagcgcatcgctgtttacgcagagcgcgatccaaagaacctggactgggctgcacacaacgttgacatcgtgatcgagtccaccggcttcttcaccgatgcaaacgcggctaaggctcacatcgaagcaggtgccaagaaggtcatcatctccgcaccagcaagcaacgaagacgcaaccttcgtttacggtgtgaaccacgagtcctacgatcctgagaaccacaacgtgatctccggcgcatcttgcaccaccaactgcctcgcaccaatggcaaaggtcctaaacgacaagttcggcatcgagaacggcctcatgaccaccgttcacgcatacactggcgaccagcgcctgcacgatgcacctcaccgcgacctgcgtcgtgcacgtgcagcagcagtcaacatcgttcctacctccaccggtgcagctaaggctgttgctctggttctcccagagctcaagggcaagcttgacggctacgcacttcgcgttccagttatcaccggttccgcaaccgacctgaccttcaacaccaagtctgaggtcaccgttgagtccatcaacgctgcaatcaaggaagctgcagtcggcgagttcggcgagaccctggcttactccgaagagccactggtttccaccgacatcgtccacgattcccacggctccatcttcgacgctggcctgaccaaggtctccggcaacaccgtcaaggttgtttcctggtacgacaacgagtggggctacacctgccagctcctgcgtctgaccgagctcgtagcttccaagctctaattagttcacatcgctaacgt

SEQ ID NO: 68 - protein, 334 aa, Corynebacterium glutamicum
MTIRVGINGFGRIGRNFFRAVLERSDDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASKL

SEQ ID NO: 69 - DNA, 1338 bp, Corynebacterium glutamicum
  CDS (101)..(1315): RXA02257
ataccggtgccagcgccacacaatgtgtggcaatctgggacagtgcatcacattgcaccagaagaattttttaaacaatcaaatctccaaggagtacggcatggctgttaagaccctcaaggacttgctcgacgaaggcgtagacggacgccacgtcatcgttcgatctgacttcaatgttcccctcaacgatgaccgcgagatcaccgataagggccgaatcattgcctccctaccaacccttaaagcactgagcgaaggtggcgcaaaggtcatcgtcatggctcaccttggccgcccaaagggcgaggtcaacgagaagtactccctcgcacctgtcgctgaggcactctccgatgagcttggccagtacgttgcacttgccgcagacgttgttggcgaagacgcacacgagcgcgcaaacggcctgaccgagggcgacatcctgctcctggagaacgtgcgcttcgacccacgcgaaacctccaaggacgaggcagagcgcaccgctttcgctcaggagctcgcagctcttgcagcagacaacggcgcattcgtttctgacggcttcggtgttgtccaccgcgcacagacctccgtctacgacattgcaaagttgctgccacactacgctggcggactggtagagaccgagatttccgttctggaaaagatcgcagaatcaccagaggcaccatacgtagtggttctcggtggatccaaggtctctgacaagatcggtgttattgaggcgctggctgccaaggctgacaagatcatcgtcggtggcggcatgtgctacaccttcctcgcagctcagggacacaacgttcagcagtccctcctgcaggaagaaatgaaggctacctgcaccgacctgctcgcacgcttcggtgacaagatcgttctcccagttgacctggttgcagcatccgaatttaacaaggacgcagagaagcagatcgttgacctggactccatcccagaaggctggatgtctcttgacatcggaccagagtccgtcaagaacttcggtgaggttctcagcaccgctaagaccatcttctggaacggcccaatgggcgtgttcgagttcgcagcattctctgaaggcacccgcggcatcgcccaggccatcatcgatgcaactgcaggcaacgacgcattctccgttgttggcggtggcgactccgcagcatccgttcgcgtgctcggcctgaacgaagacggcttctcccacatctccaccggtggtggcgcatccctcgagtaccttgaaggcaaggaactcccaggcgttgcaattctcgctcagtaaatccgacacggccctttgtt

SEQ ID NO: 70 - protein, 405 aa, Corynebacterium glutamicum
MAVKTLKDLLDEGVDGRHVIVRSDFNVPLNDDREITDKGRIIASLPTLKALSEGGAKVIVMAHLGRPKGEVNEKYSLAPVAEALSDELGQYVALAADVVGEDAHERANGLTEGDILLLENVRFDPRETSKDEAERTAFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLARFGDKIVLPVDLVAASEFNKDAEKQIVDLDSIPEGWMSLDIGPESVKNFGEVLSTAKTIFWNGPMGVFEFAAFSEGTRGIAQAIIDATAGNDAFSVVGGGDSAASVRVLGLNEDGFSHISTGGGASLEYLEGKELPGVAILAQ

SEQ ID NO: 71 - DNA, 1398 bp, Corynebacterium glutamicum
  CDS (101)..(1375): RXA00235
cgaaacaagattcgtgcaacaattgggtgtagacgtgattgaagacatttgatcacgtgaataattctagttagctcccaagttggcataggaggccacagtggctgaaatcatgcacgtattcgctcgcgaaattctcgactcccgcggtaacccaaccgtcgaggcagaggttttcctggatgacggttcccacggtgtcgcaggtgttccatccggcgcatccaccggcgtccacgaggctcatgagctgcgtgacggtggcgatcgctacctgggcaagggcgttttgaaggcagttgaaaacgtcaacgaagaaatcggcgacgagctcgctggcctagaggctgacgatcagcgcctcatcgacgaagcaatgatcaagcttgatggcaccgccaacaagtcccgcctgggtgcaaacgcaatccttggtgtttccatggctgttgcaaaggctgctgctgattccgcaggcctcccactgttccgctacatcggtggaccaaacgcacacgttcttccagttccaatgatgaacatcatcaccggtggcgctcacgctgactccggtgttgacgttcaggaattcatgatcgctccaatcggtgcagagaccttctctgaggctctccgcaacggcgcggaggtctaccacgcactgaagtccgtcatcaaggaaaagggcctgtccaccggacttggcgatgagggcggcttcgctccttccgtcggctccacccgtgaggctcttgaccttatcgttgaggcaatcgagaaggctggcttcaccccaggcaaggacatcgctcttgctctggacgttgcttcctctgagttcttcaaggacggcacctaccacttcgaaggtggccagcactccgcagctgagatggcaaacgtttacgctgagctcgttgacgcgtacccaatcgtctccatcgaggacccactgcaggaagatgactgggagggttacaccaacctcaccgcaaccatcggcgacaaggttcagatcgttggcgacgacttcttcgtcaccaaccctgagcgcctgaaggagggcatcgctaagaaggctgccaactccatcctggttaaggtgaaccagatcggtaccctcaccgagaccttcgacgctgtcgacatggctcaccgcgcaggctacacctccatgatgtcccaccgttccggtgagaccgaggacaccaccattgctgacctcgcagttgcactcaactgtggccagatcaagactggtgctccagcacgttccgaccgtgtcgcaaagtacaaccagcttctccgcatcgagcagctgcttggcgacgccggcgtctacgcaggtcgcagcgcattcccacgctttcagggctaaataaaagcgcttttcgacgc

SEQ ID NO: 72 - protein, 425 aa, Corynebacterium glutamicum
VAEIMHVFAREILDSRGNPTVEAEVFLDDGSHGVAGVPSGASTGVHEAHELRDGGDRYLGKGVLKAVENVNEEIGDELAGLEADDQRLIDEAMIKLDGTANKSRLGANAILGVSMAVAKAAADSAGLPLFRYIGGPNAHVLPVPMMNIITGGAHADSGVDVQEFMIAPIGAETFSEALRNGAEVYHALKSVIKEKGLSTGLGDEGGFAPSVGSTREALDLIVEAIEKAGFTPGKDIALALDVASSEFFKDGTYHFEGGQHSAAEMANVYAELVDAYPIVSIEDPLQEDDWEGYTNLTATIGDKVQIVGDDFFVTNPERLKEGIAKKAANSILVKVNQIGTLTETFDAVDMAHRAGYTSMMSHRSGETEDTTIADLAVALNCGQIKTGAPARSDRVAKYNQLLRIEQLLGDAGVYAGRSAFPRFQG

SEQ ID NO: 73 - DNA, 1554 bp, Corynebacterium glutamicum
  CDS (101)..(1531): RXA01093
cagaggcgtagaacattgtctgttcacactctgggtcgcaagattcatcgagaattaatggtagtacctgtggcttgagggggaatgacgtactaggcttatgggcgtggatagacgaactaagattgtatgtaccctaggcccagcggtggctagtgcagatggaattctgcgtttggtagaagacggcatggatgttgctcgcctcaacttctcccatggtgaccacccagatcatgagcaaaactacaagtgggtccgcgaggcggcggagaagactggccgtgcagtcggtattctcgcagacctccaaggaccgaagatccgtcttggccgtttcactgacggcgcaaccgtgtgggaaaacggcgagaccattcggatcaccgttgacgatgtagagggaacgcacgatcgtgtgtccaccacctacaagaatctggcaaaagacgcgaagccaggcgaccgcctgctcgttgatgacggcaaggttggcctcgtctgcgtttccgtcgaaggtaacgacgtcatctgtgaggttgttgagggcggaccagtctccaacaacaagggtgtttccctgccaggtatggatatttccgtacctgcactgtccgaaaaggatatccgtgacctgcgcttcgccctgaagctcggcgtggactttattgcactgtccttcgtacgttccccagcagatgctgaactcgttcacaagatcatggacgaagaaggtcgtcgtgttcctgtgatcgccaagctggaaaagccagaggctgtcacctccctcgagccaatcgtgttggcattcgacgccgtcatggttgctcgtggtgacctcggcgttgaggttcctctggaggaggttccactggttcagaagcgcgcaatccagattgcccgtgagaacgcaaagccagttatcgtggcaacccagatgctggattccatgattgagaactcccgcccaacccgtgcggaagcttctgacgtggcaaacgctgtgctcgatggcgcagatgctgtcatgctttctggtgaaacttcagtgggcaaagatccgcacaacgttgtgcgcaccatgtctcgcattgttcgcttcgctgaaaccgacggtcgcgtcccagacctgacccacatccctcgcactaagcgtggcgttatttcctactctgcacgtgatatcgccgagcgcctcaacgctcgtgcattggttgcgttcaccacctctggtgataccgcaaagcgtgtggctcgtctgcacagccacctgccactgctcgtgttcactccaaatgaggcagttcgctctgagctggcgctgacctggggtgcaaccaccttcctgtgtccacctgtcagcgataccgatgacatgatgcgcgaagtcgaccgtgctcttttagcaatgcctgagtacaacaagggtgacatgatggttgttgttgcaggttcccctcctggtgttaccggtaacaccaacatgattcacgtccaccttcttggtgacgacacaaggattgcaaagctctaatcgcttaaatctttcaaaaa

SEQ ID NO: 74 - protein, 477 aa, Corynebacterium glutamicum
MGVDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 75 - DNA, 1980 bp, Corynebacterium glutamicum
  CDS (101)..(1957): RXN02675
aagtgtttcattggaacacttgcgctgccaactttttggtttacgggcacaatgaaactgttggatggaatttagagtgtttgtagcttaaggagctcaaatgaatgagtttgaccaggacattctccaggagatcaagactgaactcgacgagttaattctagaacttgatgaggtgacacaaactcacagcgaggccatcgggcaggtctccccaacccattacgttggtgcccgcaacctcatgcattacgcgcatcttcgcaccaaagacctccgtggcctgcagcaacgcctctcctctgtgggagctacccgcttgactaccaccgaaccagcagtgcaggcccgcctcaaggccgcccgcaatgttatcggagctttcgcaggtgaaggcccactttatccaccctcagatgtcgtcgatgccttcgaagatgccgatgagattctcgacgagcacgccgaaattctccttggcgaacccctaccggatactccatcctgcatcatggtcaccctgcccaccgaagccgccaccgacattgaacttgtccgtggcttcgccaaaagcggcatgaatctagctcgcatcaactgtgcacacgacgatgaaaccgtctggaagcagatgatcgacaacgtccacaccgttgcagaagaagttggccgggaaatccgcgtcagcatggacctcgccggaccaaaagtacgcaccggcgaaatcgccccaggcgcagaagtaggtcgcgcacgagtaacccgcgacgaaaccggaaaagtactgacgcccgcaaaactgtggatcaccgcccacggctccgaaccagtcccagcccccgaaagcctgcccggtcgccccgctctgccgattgaagtcaccccagaatggttcgacaaactagaaatcggcagcgtcatcaacgtcccagacacccgcggatcccgccgagcattcaccgtgaccagggtttttgatggcgcggtcctcgccgaaggcccacaaaaagcctacatctccaacggcaccctcctggaacacaactacgaccgctcccgggtctacggcatccccgccgtagttcagcgcatcaacctcaaagtcggcgaccgcctcatccttaccgacgaagaactcacctacgatccatccctcggatccggccgcacaccacgcatcagctgcacccttccacaagcagtcgatgcaattaaagtcgggcaccgcgtgcttttcgacgacggagccatcgccgcagtctgcatcgacaagacctccactgccgacggccacaacgacgtagaattggaagtcacccacgcccgcccacaaggcgtaaacctggccgcatacaagggaatcaacctcccagactccgaacttccactcccaagcctcactgaagaagacctccaacacctgcgctttgtcgtcaaatacgccgacatcgcagccatctccttcatccgaaacgtcgccgacgtggaatacctcctccaagcactcgccgacatcggagatccagtagccgtcgaacgccttggcctcgtccttaaaatcgagaccatcccaggctacgaaggcctcgcccaaatcctcctgaccggcatgcgccacgaaaacttcggcatcatgatcgcccgcggagacctcgccgtcgaactcggcttcgaccgcatggcagaagtcccccaactgatcatggcccttgccgaagccgcccacgtcccaaccatcttggccacccaagtcctggaaaacatggccaaaaacggactcccatctcgcgcagaaatcaccgacgcagcaatggcacttcgcgctgaatgcgtcatgctgaacaagggaccacacatcaacgacgccatcaaggtcctcaccgaaatgagccgcaaacttggtgcatcccaacgaaagagtaggctgctgctgcgcaaggtgaagagctgggaagagtaactcacaaaggcgattggcgt

SEQ ID NO: 76 - protein, 619 aa, Corynebacterium glutamicum
MNEFDQDILQEIKTELDELILELDEVTQTHSEAIGQVSPTHYVGARNLMHYAHLRTKDLRGLQQRLSSVGATRLTTTEPAVQARLKAARNVIGAFAGEGPLYPPSDVVDAFEDADEILDEHAEILLGEPLPDTPSCIMVTLPTEAATDIELVRGFAKSGMNLARINCAHDDETVWKQMIDNVHTVAEEVGREIRVSMDLAGPKVRTGEIAPGAEVGRARVTRDETGKVLTPAKLWITAHGSEPVPAPESLPGRPALPIEVTPEWFDKLEIGSVINVPDTRGSRRAFTVTRVFDGAVLAEGPQKAYISNGTLLEHNYDRSRVYGIPAVVQRINLKVGDRLILTDEELTYDPSLGSGRTPRISCTLPQAVDAIKVGHRVLFDDGAIAAVCIDKTSTADGHNDVELEVTHARPQGVNLAAYKGINLPDSELPLPSLTEEDLQHLRFVVKYADIAAISFIRNVADVEYLLQALADIGDPVAVERLGLVLKIETIPGYEGLAQILLTGMRHENFGIMIARGDLAVELGFDRMAEVPQLIMALAEAAHVPTILATQVLENMAKNGLPSRAEITDAAMALRAECVMLNKGPHINDAIKVLTEMSRKLGASQRKSRLLLRKVKSWEE

SEQ ID NO: 77 - DNA, 386 bp, Corynebacterium glutamicum
  CDS (1)..(363): FRXA02675
atcctcatgaccggcatgcgccacgaaaacttcggcatcatgatcgcccgcggagacctcgccgtcgaactcggcttcgaccgcatggcagaagtcccccaactgatcatggcccttgcagaagccgcccacgtcccaaccatcttggccacccaagtcctggaaaacatggccaaaaacggactcccatctcgcgcagaaatcaccgacgcagcaatggcacttcgcgctgaatgcgtcatgctgaacaagggaccacacatcaacgacgccatcaaggtcctcaccgaaatgagccgcaaacttggtgcatcccaacgaaagagtaggctgctgctgcgcaaggtgaagagctgggaagagtaactcacaaaggcgattggcgt

SEQ ID NO: 78 - protein, 121 aa, Corynebacterium glutamicum
ILMTGMRHENFGIMIARGDLAVELGFDRMAEVPQLIMALAEAAHVPTILATQVLENMAKNGLPSRAEITDAAMALRAECVMLNKGPHINDAIKVLTEMSRKLGASQRKSRLLLRKVKSWEE

SEQ ID NO: 79 - DNA, 1522 bp, Corynebacterium glutamicum
  CDS (101)..(1522): FRXA02695
aagtgtttcattggaacacttgcgctgccaactttttggtttacgggcacaatgaaactgttggatggaatttagagtgtttgtagcttaaggagctcaaatgaatgagtttgaccaggacattctccaggagatcaagactgaactcgacgagttaattctagaacttgatgaggtgacacaaactcacagcgaggccatcgggcaggtctccccaacccattacgttggtgcccgcaacctcatgcattacgcgcatcttcgcaccaaagacctccgtggcctgcagcaacgcctctcctctgtgggagctacccgcttgactaccaccgaaccagcagtgcaggcccgcctcaaggccgcccgcaatgttatcggagctttcgcaggtgaaggcccactttatccaccctcagatgtcgtcgatgccttcgaagatgccgatgagattctcgacgagcacgccgaaattctccttggcgaacccctaccggatactccatcctgcatcatggtcaccctgcccaccgaagccgccaccgacattgaacttgtccgtggcttcgccaaaagcggcatgaatctagctcgcatcaactgtgcacacgacgatgaaaccgtctggaagcagatgatcgacaacgtccacaccgttgcagaagaagttggccgggaaatccgcgtcagcatggacctcgccggaccaaaagtacgcaccggcgaaatcgccccaggcgcagaagtaggtcgcgcacgagtaacccgcgacgaaaccggaaaagtactgacgcccgcaaaactgtggatcaccgcccacggctccgaaccagtcccagcccccgaaagcctgcccggtcgccccgctctgccgattgaagtcaccccagaatggttcgacaaactagaaatcggcagcgtcatcaacgtcccagacacccgcggatcccgccgagcattcaccgtgaccagggtttttgatggcgcggtcctcgccgaaggcccacaaaaagcctacatctccaacggcaccctcctggaacacaactacgaccgctcccgggtctacggcatccccgccgtagttcagcgcatcaacctcaaagtcggcgaccgcctcatccttaccgacgaagaactcacctacgatccatccctcggatccggccgcacaccacgcatcagctgcacccttccacaagcagtcgatgcaattaaagtcgggcaccgcgtgcttttcgacgacggagccatcgccgcagtctgcatcgacaagacctccactgccgacggccacaacgacgtagaattggaagtcacccacgcccgcccacaaggcgtaaacctggccgcatacaagggaatcaacctcccagactccgaacttccactcccaagcctcactgaagaagacctccaacacctgcgctttgtcgtcaaatacgccgacatcgcagccatctccttcatccgaaacgtcgccgacgtggaatacctcctccaagcactcgccgacatcggagat

SEQ ID NO: 80 - protein, 474 aa, Corynebacterium glutamicum
MNEFDQDILQEIKTELDELILELDEVTQTHSEAIGQVSPTHYVGARNLMHYAHLRTKDLRGLQQRLSSVGATRLTTTEPAVQARLKAARNVIGAFAGEGPLYPPSDVVDAFEDADEILDEHAEILLGEPLPDTPSCIMVTLPTEAATDIELVRGFAKSGMNLARINCAHDDETVWKQMIDNVHTVAEEVGREIRVSMDLAGPKVRTGEIAPGAEVGRARVTRDETGKVLTPAKLWITAHGSEPVPAPESLPGRPALPIEVTPEWFDKLEIGSVINVPDTRGSRRAFTVTRVFDGAVLAEGPQKAYISNGTLLEHNYDRSRVYGIPAVVQRINLKVGDRLILTDEELTYDPSLGSGRTPRISCTLPQAVDAIKVGHRVLFDDGAIAAVCIDKTSTADGHNDVELEVTHARPQGVNLAAYKGINLPDSELPLPSLTEEDLQHLRFVVKYADIAAISFIRNVADVEYLLQALADIGD

SEQ ID NO: 81 - DNA, 2022 bp, Corynebacterium glutamicum
  CDS (101)..(1999): RXA00682
ataggcaccttcgatttcagctcaatcaccgtcgcaatgaccggcacgaagtaaaaccaccgcatcttttcgtcgaaaagcatctaaaaggagtttgaccatggctaataaatctttccccaagccctccgatcttccagtgcccaagggcgctgaaggttgggaagatctgtacccgtactacctcgttttccaagacaagctcatggatcaagagaatgagaaattctggttctgcgattcacagcactggccaactgtgttcaagccttttgaaactatcggtggtgaattcgctgtaaagtgcctcggccaatacaacgctcggcatttgatgatcccgaatgccaatggcatcgagttccgcgtgcatctgggatacctctatatgtcccctattccagtgcctgaagatcagattgcggaacgcgtccccatgttccaggaacgcatcacgcactacttccaaaactgggagccaatgctggcaaattggaaggagcgagtattaggaaccatcaatgagctggaatctctagaattcaagccactgcctgactacgtgcctatcgatgatattgtctccggaaaagccaaagacggcaccgaagtactcatggaaaacttcgatcggctcattcagctcgcctaccaaaactggcaataccactttgagttcctcaacttgggttacatcgcttacctagatttcttcaatttctgcaaggaagtcttcccagatatccctgatcaatcaatttcgatgatggttcagggcgtggatatggagctgttccgccccgatgatgaactaaagattctggcacagctagcggtcgaccttggcctgcaaactcactttgccaacccggatgatccgcaagctaccttggctgctatcgcaaaggcagaaggcggcgcgacatggatagcgcgctgggaagaagcacaagatccgtggttcaacttcaccgtcggtaatggcttctacggtcacgataaatactggatcgagcacctggaacttccactggggtacatcgcggattacatccgccgcctagatgaaggccaaaccatctcccgcccgaaagatgaactcatcgcagaaaaggaacgcgtggtggaagaataccgcgaccttttggatggagaacaactcgcgcagtttgatgctaaatgcggcctcgctgctactgcatacccctatgtggaaaaccataacttctacatcgagcactggaccatgtcagtattttggcgcaaagtacgcgaactttcccgcactctccagggctacggtttctgggagaacgaggatgacatgttgtacctcaaccgcactgaagtccgcgatgtcctcttcgacctggctactgcgtggggtgtcggcgcacccggtggtccaattggcacgatcatttggccggaagaaattgagcgaagaaaagcaattgtcaccgctttgaaaactgcccgaccagcgccagctcttaacactcctccagagtccatcaccgaacctttcacccgcatgctctggggaatcaccaccgaacaggtgcaatcatggttgggcaatgacgaggatgccgaagaaggaacccttaaaggcatggctgcatcccctggtgtggtggaaggctacgctcgagtaattctcagcgcagatgacctttcagaaatccagcaggatgaaatcctcgttgcccctgtaacagcaccttcttggggcccaatctttggcaaaatcaaggcaacagtcactgatattggtggcatgatgagccatgctgcgatcgtgtgccgcgaatacggcttgccggctgttactggaactggcgctgcatccaccaccatcaaaaccggcgattacctcaaggtcgatggaaccaagggcaaggttgtcattgttgatccagatgcgccacgcatcgaaggacccggcgcgcacagccatgcgcactcagtagcagcacatggggtggatacacatgcctagtccacgcactgttcttatca

SEQ ID NO: 82 - protein, 633 aa, Corynebacterium glutamicum
MANKSFPKPSDLPVPKGAEGWEDLYPYYLVFQDKLMDQENEKFWFCDSQHWPTVFKPFETIGGEFAVKCLGQYNARHLMIPNANGIEFRVHLGYLYMSPIPVPEDQIAERVPMFQERITHYFQNWEPMLANWKERVLGTINELESLEFKPLPDYVPIDDIVSGKAKDGTEVLMENFDRLIQLAYQNWQYHFEFLNLGYIAYLDFFNFCKEVFPDIPDQSISMMVQGVDMELFRPDDELKILAQLAVDLGLQTHFANPDDPQATLAAIAKAEGGATWIARWEEAQDPWFNFTVGNGFYGHDKYWIEHLELPLGYIADYIRRLDEGQTISRPKDELIAEKERVVEEYRDLLDGEQLAQFDAKCGLAATAYPYVENHNFYIEHWTMSVFWRKVRELSRTLQGYGFWENEDDMLYLNRTEVRDVLFDLATAWGVGAPGGPIGTIIWPEEIERRKAIVTALKTARPAPALNTPPESITEPFTRMLWGITTEQVQSWLGNDEDAEEGTLKGMAASPGVVEGYARVILSADDLSEIQQDEILVAPVTAPSWGPIFGKIKATVTDIGGMMSHAAIVCREYGLPAVTGTGAASTTIKTGDYLKVDGTKGKVVIVDPDAPRIEGPGAHSHAHSVAAHGVDTHA

SEQ ID NO: 83 - DNA, 1215 bp, Corynebacterium glutamicum
  CDS (101)..(1192): RXA00683
ggacaaagctatcgggttccgggagaacctctccttccgcgtccccacttctgttcccgtgacttggaacgcttaacgctttattaaataaggagacaccatgaccaacagtttgaacatcccgtttgtccagcgcttcgatgaaggcctggatcctgttctagaagtactcggtggcaagggcgcttcactagtcaccatgacagatgctggaatgcccgttccacctggatttgtggtcactactgccagctttgatgaattcatccgtgaagcaggggttgctgaacacatcgataaattcctaaacgatctcgatgcagaagatgttaaggaagtggatcgagtttctgcgatcatccgcgatgagctgtgcagtcttgacgttccagagaatgctcgtttcgcagtgcaccaggcttatcgcgatctcatggaacgatgcggtggcgacgtcccggttgctgtccggtcatcggccactgccgaagatctgcccgatgcttccttcgcagggcaacaggacacctatctgtggcaagtcggtttgagcgctgtcactgaacacatccgtaaatgctgggcttcgctgttcacttcccgtgccattatctaccgtctgaaaaacaacatccccaatgagggcctctccatggcggtagttgttcaaaaaatggtcaactctcgtgtcgcaggcgtggcaatcactatgaatccttccaacggcgaccgctcgaagatcaccatcgattcctcatggggtgttggtgaaatggtggtctcaggtgaagtgacaccagacaatatcttgctggacaagatcacgctgcaggttgtctccgaacacattggaagcaaacacgctgaactcatccccgatgccaccagtggaagcctcgtggaaaagcccgttgatgaagaacgcgcaaaccgccgcagtctgactgatgaggaaatgctcgctgtggcacaaatggctaagcgtgcagaaaaacactacaagtgcccacaagatatcgaatgggcgctggacgctgatctgccagatggagaaaaccttctgttattgcaatcccgcccggaaactatccactccaacggtgtgaagaaggaaaccccaactccgcaggctgccaaaaccataggcaccttcgatttcagctcaatcaccgtcgcaatgaccggcacgaagtaaaaccaccgcatcttttcgtc

SEQ ID NO: 84 - protein, 364 aa, Corynebacterium glutamicum
MTNSLNIPFVQRFDEGLDPVLEVLGGKGASLVTMTDAGMPVPPGFVVTTASFDEFIREAGVAEHIDKFLNDLDAEDVKEVDRVSAIIRDELCSLDVPENARFAVHQAYRDLMERCGGDVPVAVRSSATAEDLPDASFAGQQDTYLWQVGLSAVTEHIRKCWASLFTSRAIIYRLKNNIPNEGLSMAVVVQKMVNSRVAGVAITMNPSNGDRSKITIDSSWGVGEMVVSGEVTPDNILLDKITLQVVSEHIGSKHAELIPDATSGSLVEKPVDEERANRRSLTDEEMLAVAQMAKRAEKHYKCPQDIEWALDADLPDGENLLLLQSRPETIHSNGVKKETPTPQAAKTIGTFDFSSITVAMTGTK

SEQ ID NO: 85 - DNA, 1860 bp, Corynebacterium glutamicum
  CDS (101)..(1837): RXN00635
ctggcaggcgggcgaagcgtggcaacaactggaatttaagagcacaattgaagtcgcaccaagttaggcaacacaatagccataacgttgaggagttcagatggcacacagctacgcagaacaattaattgacactttggaagctcaaggtgtgaagcgaatttatggtttggtgggtgacagccttaatccgatcgtggatgctgtccgccaatcagatattgagtgggtgcacgttcgaaatgaggaagcggcggcgtttgcagccggtgcggaatcgttgatcactggggagctggcagtatgtgctgcttcttgtggtcctggaaacacacacctgattcagggtctttatgattcgcatcgaaatggtgcgaaggtgttggccatcgctagccatattccgagtgcccagattggttcgacgttcttccaggaaacgcatccggagattttgtttaaggaatgctctggttactgcgagatggtgaatggtggtgagcagggtgaacgcattttgcatcacgcgattcagtccaccatggcgggtaaaggtgtgtcggtggtagtgattcctggtgatatcgctaaggaagacgcaggtgacggtacttattccaattccactatttcttctggcactcctgtggtgttcccggatcctactgaggctgcagcgctggtggaggcgattaacaacgctaagtctgtcactttgttctgcggtgcgggcgtgaagaatgctcgcgcgcaggtgttggagttggcggagaagattaaatcaccgatcgggcatgcgctgggtggtaagcagtacatccagcatgagaatccgtttgaggtcggcatgtctggcctgcttggttacggcgcctgcgtggatgcgtccaatgaggcggatctgctgattctattgggtacggatttcccttattctgatttccttcctaaagacaacgttgcccaggtggatatcaacggtgcgcacattggtcgacgtaccacggtgaagtatccggtgaccggtgatgttgctgcaacaatcgaaaatattttgcctcatgtgaaggaaaaaacagatcgttccttccttgatcggatgctcaaggcacacgagcgtaagttgagctcggtggtagagacgtacacacataacgtcgagaagcatgtgcctattcaccctgaatacgttgcctctattttgaacgagctggcggataaggatgcggtgtttactgtggataccggcatgtgcaatgtgtggcatgcgaggtacatcgagaatccggagggaacgcgcgactttgtgggttcattccgccacggcacgatggctaatgcgttgcctcatgcgattggtgcgcaaagtgttgatcgaaaccgccaggtgatcgcgatgtgtggcgatggtggtttgggcatgctgctgggtgagcttctgaccgttaagctgcaccaacttccgctgaaggctgtggtgtttaacaacagttctttgggcatggtgaagttggagatgctcgtggagggacagccagaatttggtactgaccatgaggaagtgaatttcgcagagattgcggcggctgcgggtatcaaatcggtacgcatcaccgatccgaagaaagttcgcgagcagctagctgaggcattggcatatcctggacctgtactgatcgatatcgtcacggatcctaatgcgctgtcgatcccaccaaccatcacgtgggaacaggtcatgggattcagcaaggcggccacccgaaccgtctttggtggaggagtaggagcgatgatcgatctggcccgttcgaacataaggaatattcctactccatgatgattgatacacctgctgtt

SEQ ID NO: 86 - protein, 579 aa, Corynebacterium glutamicum
MAHSYAEQLIDTLEAQGVKRIYGLVGDSLNPIVDAVRQSDIEWVHVRNEEAAAFAAGAESLITGELAVCAASCGPGNTHLIQGLYDSHRNGAKVLAIASHIPSAQIGSTFFQETHPEILFKECSGYCEMVNGGEQGERILHHAIQSTMAGKGVSVVVIPGDIAKEDAGDGTYSNSTISSGTPVVFPDPTEAAALVEAINNAKSVTLFCGAGVKNARAQVLELAEKIKSPIGHALGGKQYIQHENPFEVGMSGLLGYGACVDASNEADLLILLGTDFPYSDFLPKDNVAQVDINGAHIGRRTTVKYPVTGDVAATIENILPHVKEKTDRSFLDRMLKAHERKLSSVVETYTHNVEKHVPIHPEYVASILNELADKDAVFTVDTGMCNVWHARYIENPEGTRDFVGSFRHGTMANALPHAIGAQSVDRNRQVIAMCGDGGLGMLLGELLTVKLHQLPLKAVVFNNSSLGMVKLEMLVEGQPEFGTDHEEVNFAEIAAAAGIKSVRITDPKKVREQLAEALAYPGPVLIDIVTDPNALSIPPTITWEQVMGFSKAATRTVFGGGVGAMIDLARSNIRNIPTP

SEQ ID NO: 87 - DNA, 552 bp, Corynebacterium glutamicum
  CDS (88)..(552): FRXA02807
aaagcgtggcaacaactggaatttaagagcacaattgaagtcgcaccaagttaggcaacacaatagccataacgttgaggagttcagatggcacacagctacgcagaacaattaattgacactttggaagctcaaggtgtgaagcgaatttatggtttggtgggtgacagccttaatccgatcgtggatgctgtccgccaatcagatattgagtgggtgcacgttcgaaatgaggaagcggcggcgtttgcagccggtgcggaatcgttgatcactggggagctggcagtatgtgctgcttcttgtggtcctggaaacacacacctgattcagggtctttatgattcgcatcgaaatggtgcgaaggtgttggccatcgctagccatattccgagtgcccagattggttcgacgttcttccaggaaacgcatccggagattttgtttaaggaatgctctggttactgcgagatggtgaatggtggtgagcagggtgaacgcattttgcatcacgcgattcagtccaccatggcgggtaaaggtgtgtcggtg

SEQ ID NO: 88 - protein, 155 aa, Corynebacterium glutamicum
MAHSYAEQLIDTLEAQGVKRIYGLVGDSLNPIVDAVRQSDIEWVHVRNEEAAAFAAGAESLITGELAVCAASCGPGNTHLIQGLYDSHRNGAKVLAIASHIPSAQIGSTFFQETHPEILFKECSGYCEMVNGGEQGERILHHAIQSTMAGKGVSV

SEQ ID NO: 89 - DNA, 944 bp, Corynebacterium glutamicum
  CDS (1)..(921): FRXA00635
ggtacggatttcccttattctgatttccttcctaaagacaacgttgcccaggtggatatcaacggtgcgcacattggtcgacgtaccacggtgaagtatccggtgaccggtgatgttgctgcaacaatcgaaaatattttgcctcatgtgaaggaaaaaacagatcgttccttccttgatcggatgctcaaggcacacgagcgtaagttgagctcggtggtagagacgtacacacataacgtcgagaagcatgtgcctattcaccctgaatacgttgcctctattttgaacgagctggcggataaggatgcggtgtttactgtggataccggcatgtgcaatgtgtggcatgcgaggtacatcgagaatccggagggaacgcgcgactttgtgggttcattccgccacggcacgatggctaatgcgttgcctcatgcgattggtgcgcaaagtgttgatcgaaaccgccaggtgatcgcgatgtgtggcgatggtggtttgggcatgctgctgggtgagcttctgaccgttaagctgcaccaacttccgctgaaggctgtggtgtttaacaacagttctttgggcatggtgaagttggagatgctcgtggagggacagccagaatttggtactgaccatgaggaagtgaatttcgcagagattgcggcggctgcgggtatcaaatcggtacgcatcaccgatccgaagaaagttcgcgagcagctagctgaggcattggcatatcctggacctgtactgatcgatatcgtcacggatcctaatgcgctgtcgatcccaccaaccatcacgtgggaacaggtcatgggattcagcaaggcggccacccgaaccgtctttggtggaggagtaggagcgatgatcgatctggcccgttcgaacataaggaatattcctactccatgatgattgatacacctgctgtt

SEQ ID NO: 90 - protein, 307 aa, Corynebacterium glutamicum
GTDFPYSDFLPKDNVAQVDINGAHIGRRTTVKYPVTGDVAATIENILPHVKEKTDRSFLDRMLKAHERKLSSVVETYTHNVEKHVPIHPEYVASILNELADKDAVFTVDTGMCNVWHARYIENPEGTRDFVGSFRHGTMANALPHAIGAQSVDRNRQVIAMCGDGGLGMLLGELLTVKLHQLPLKAVVFNNSSLGMVKLEMLVEGQPEFGTDHEEVNFAEIAAAAGIKSVRITDPKKVREQLAEALAYPGPVLIDIVTDPNALSIPPTITWEQVMGFSKAATRTVFGGGVGAMIDLARSNIRNIPTP

SEQ ID NO: 91 - DNA, 954 bp, Corynebacterium glutamicum
  CDS (101)..(931): RXN03044
tacgccacccacggcaaggccatgattccgctgtacatcttctactcgatgttcgggattccagcgcaccggtgactccatctgggcagcagccgatcagatggcacgtggcttcctcttgggcgctaccgcaggtcgcaccaccctgaccggtgaaggcctccagcacatggatggacactcccctgtcttggcttccaccaacgagggtgtcgagacctacgacccatcctttgcgtacgagatcgcacacctggttcaccgtggcatcgaccgcatgtacggcccaggcaagggtgaagatgttatctactacatcaccatctacaacgagccaaccccacagccagctgagccagaaggactggacgtagaaggcctgcacaagggcatctacctctactcccgcggtgaaggcaccggccatgaggcaaacatcttggcttccggtgttggtatgcagtgggctctcaaggctgcatccatccttgaggctgactacggagttcgtgccaacatttactccgctacttcttgggttaacttggctcgcgatggcgctgctcgtaacaaggcacagctgcgcaacccaggtgcagatgctggcgaggcattcgtaaccacccagctgaagcagacctccggcccatacgttgcagtgtctgacttctccactgatctgccaaaccagatccgtgaatgggtcccaggcgactacaccgttctcggtgcagatggcttcggtttctctgatacccgcccagctgctcgtcgcttcttcaacatcgacgctgagtccattgttgttgcagtgctgaactccctggcacgcgaaggcaagatcgacgtctccgttgctgctcaggctgctgagaagttcaagttggatgatcctacgagtgtttccgtagatccaaacgctcctgaggaataaatcacctcaagggacagata

SEQ ID NO: 92 - protein, 277 aa, Corynebacterium glutamicum
MARGFLLGATAGRTTLTGEGLQHMDGHSPVLASTNEGVETYDPSFAYEIAHLVHRGIDRMYGPGKGEDVIYYITIYNEPTPQPAEPEGLDVEGLHKGIYLYSRGEGTGHEANILASGVGMQWALKAASILEADYGVRANIYSATSWVNLARDGAARNKAQLRNPGADAGEAFVTTQLKQTSGPYVAVSDFSTDLPNQIREWVPGDYTVLGADGFGFSDTRPAARRFFNIDAESIVVAVLNSLAREGKIDVSVAAQAAEKFKLDDPTSVSVDPNAPEE

SEQ ID NO: 93 - DNA, 302 bp, Corynebacterium glutamicum
  CDS (1)..(279): FRXA02852
gttgcagtgtctgacttctccactgatctgccaaaccagatccgtgaatgggtcccaggcgactacaccgttctcggtgcagatggcttcggtttctctgatacccgcccagctgctcgtcgcttcttcaacatcgacgctgagtccattgttgttgcagtgctgaactccctggcacgcgaaggcaagatcgacgtctccgttgctgctcaggctgctgagaagttcaagttggatgatcctacgagtgtttccgtagatccaaacgctcctgaggaataaatcacctcaagggacagata

SEQ ID NO: 94 - protein, 93 aa, Corynebacterium glutamicum
VAVSDFSTDLPNQIREWVPGDYTVLGADGFGFSDTRPAARRFFNIDAESIVVAVLNSLAREGKIDVSVAAQAAEKFKLDDPTSVSVDPNAPEE

SEQ ID NO: 95 - DNA, 954 bp, Corynebacterium glutamicum
  CDS (101)..(931): FRXA00268
tacgccacccacggcaaggccatgattccgctgtacatcttctactcgatgttcgggattccagcgcaccggtgactccatttgggcagcagccgatcagatggcacgtggcttctttttgggcgctaccgcaggtcgcaccaccttgaccggtgaaggcctccagcacatggatggacactcccctgttttggcttccaccaacgagggtgtcgagacctacgacccatcctttgcgtacgagatcgcacacctggttcaccgtggcatcgaccgcatgtacggcccaggcaagggtgaagatgttatctactacatcaccatctacaacgagccaaccccacagccagctgagccagaaggactggacgtagaaggcctgcacaagggcatctacctctactcccgcggtgaaggcaccggccatgaggcaaacatcttggcttccggtgttggtatgcagtgggctctcaaggctgcatccatccttgaggctgactacggagttcgtgccaacatttactccgctacttcttgggttaacttggctcgcgatggcgctgctcgtaacaaggcacagctgcgcaacccaggtgcagatgctggcgaggcattcgtaaccacccagctgaagcagacctccggcccatacgttgcagtgtctgacttctccactgatctgccaaaccagatccgtgaatgggtcccaggcgactacaccgttctcggtgcagatggcttcggtttctctgatacccgcccagctgctcgtcgcttcttcaacatcgacgctgagtccattgttgttgcagtgctgaactccctggcacgcgaaggcaagatcgacgtctccgttgctgctcaggctgctgagaagttcaagttggatgatcctacgagtgtttccgtagatccaaacgctcctgaggaataaatcacctcaagggacagata

SEQ ID NO: 96 - protein, 277 aa, Corynebacterium glutamicum
MARGFFLGATAGRTTLTGEGLQHMDGHSPVLASTNEGVETYDPSFAYEIAHLVHRGIDRMYGPGKGEDVIYYITIYNEPTPQPAEPEGLDVEGLHKGIYLYSRGEGTGHEANILASGVGMQWALKAASILEADYGVRANIYSATSWVNLARDGAARNKAQLRNPGADAGEAFVTTQLKQTSGPYVAVSDFSTDLPNQIREWVPGDYTVLGADGFGFSDTRPAARRFFNIDAESIVVAVLNSLAREGKIDVSVAAQAAEKFKLDDPTSVSVDPNAPEE

SEQ ID NO: 97 - DNA, 508 bp, Corynebacterium glutamicum
  CDS (101)..(508): RXN03086
ttcgtgcacttcggcgtgtcacaattaggtacgaccaagaatgggaccgggaaaccgggacgtataaacgaaataaaacattccaacaggaggtgtggaaatggccgatcaagcaaaacttggtggcaagccctcggatgactctaacttcgcgatgatccgcgatggcgtggcatcttatttgaacgactcagatccggaggagaccaacgagtggatggattcactcgacggattactccaggagtcttctccagaacgtgctcgttacctcatgcttcgtttgcttgagcgtgcatctgcaaagcgcgtatctcttcccccaatgacgtcaaccgactacgtcaacaccattccaacctctatggaacctgaattcccaggcgatgaggaaatggagaagcgttaccgtcgttggattcgctggaacgcagccatcatggttcaccgcgctcagcgaccaggcatcggcgtcggcggacacatttccacttacgcaggcgcagcc

SEQ ID NO: 98 - protein, 136 aa, Corynebacterium glutamicum
MADQAKLGGKPSDDSNFAMIRDGVASYLNDSDPEETNEWMDSLDGLLQESSPERARYLMLRLLERASAKRVSLPPMTSTDYVNTIPTSMEPEFPGDEEMEKRYRRWIRWNAAIMVHRAQRPGIGVGGHISTYAGAA

SEQ ID NO: 99 - DNA, 508 bp, Corynebacterium glutamicum
  CDS (101)..(508): FRXA02887
ttcgtgcacttcggcgtgccacaattaggtacgaccaagaatgggaccgggaaaccgggacgtataaacgaaataaaacattccaacaggaggtgtggaaatggccgatcaagcaaaacttggtggcaagccctcggatgactctaacttcgcgatgatccgcgatggcgtggcatcttatttgaacgactcagatccggaggagaccaacgagtggatggattcactcgacggattactccaggagtcttctccagaacgtgctcgttacctcatgcttcgtttgcttgagcgtgcatctgcaaagcgcgtatctcttcccccaatgacgtcaaccgactacgtcaacaccattccaacctctatggaacctgaattcccaggcgatgaggaaatggagaagcgttaccgtcgttggattcgctggaacgcagccatcatggttcaccgcgctcagcgaccaggcatcggcgtcggcggacacatttccacttacgcaggcgcagcc

SEQ ID NO: 100 - protein, 136 aa, Corynebacterium glutamicum; identical to SEQ ID NO: 98

SEQ ID NO: 101 - DNA, 1385 bp, Corynebacterium glutamicum
  CDS (1)..(1362): RXN03043
gatctcgatggcttccgtcaggaagtttcccgtgagcagggtggcattccgtcctaccctcacccacacggtatgaaggacttctgggagttcccaactgtgtccatgggtcttggcccaatggatgccatttaccaggcacgtttcaaccgctacctcgaaaaccgtggcatcaaggacacctctgaccagcacgtctgggccttccttggcgacggcgaaatggacgagccagaatcacgtggtctcatccagcaggctgcactgaacaacctggacaacctgaccttcgtggttaactgcaacctgcagcgtctcgacggacctgtccgcggtaacaccaagatcatccaggaactcgagtccttcttccgtggcgcaggctggtctgtgatcaaggttgtttggggtcgcgagtgggatgaacttctggagaaggaccaggatggtgcacttgttgagatcatgaacaacacctccgatggtgactaccagaccttcaaggctaacgacggcgcatatgttcgtgagcacttcttcggacgtgacccacgcaccgcaaagctcgttgagaacatgaccgacgaagaaatctggaagcttccacgtggcggccacgattaccgcaaggtttacgcagcctacaagcgagctcttgagaccaaggatcgcccaaccgtcatccttgctcacaccattaagggctacggactcggccacaacttcgaaggccgtaacgcaacccaccagatgaagaagctgacgcttgatgatctgaagttgttccgcgacaagcagggcatcccaatcaccgatgagcagctggagaaggatccttaccttcctccttactaccacccaggtgaagacgctcctgaaatcaagtacatgaaggaacgtcgcgcagcgctcggtggctacctgccagagcgtcgtgagaactacgatccaattcaggttccaccactggataagcttcgctctgtccgtaagggctccggcaagcagcagatcgctaccaccatggcgactgttcgtaccttcaaggaactgatgcgcgataagggcttggctgatcgccttgtcccaatcattcctgatgaggcacgtaccttcggtcttgactcttggttcccaaccttgaagatctacaacccgcacggtcagaactacgtgcctgttgaccacgacctgatgctctcctaccgtgaggcacctgaaggacagatcctgcacgaaggcatcaacgaggctggttccgtggcatcgttcatcgctgcgggtacctcctacgccacccacggcaaggccatgattccgctgtacatcttctactcgatgttcgggattccagcgcaccggtgactccatctgggcagcagccg

SEQ ID NO: 102 - protein, 454 aa, Corynebacterium glutamicum
DLDGFRQEVSREQGGIPSYPHPHGMKDFWEFPTVSMGLGPMDAIYQARFNRYLENRGIKDTSDQHVWAFLGDGEMDEPESRGLIQQAALNNLDNLTFVVNCNLQRLDGPVRGNTKIIQELESFFRGAGWSVIKVVWGREWDELLEKDQDGALVEIMNNTSDGDYQTFKANDGAYVREHFFGRDPRTAKLVENMTDEEIWKLPRGGHDYRKVYAAYKRALETKDRPTVILAHTIKGYGLGHNFEGRNATHQMKKLTLDDLKLFRDKQGIPITDEQLEKDPYLPPYYHPGEDAPEIKYMKERRAALGGYLPERRENYDPIQVPPLDKLRSVRKGSGKQQIATTMATVRTFKELMRDKGLADRLVPIIPDEARTFGLDSWFPTLKIYNPHGQNYVPVDHDLMLSYREAPEGQILHEGINEAGSVASFIAAGTSYATHGKAMIPLYIFYSMFGIPAHR

SEQ ID NO: 103 - DNA, 1287 bp, Corynebacterium glutamicum
  CDS (1)..(1287): FRXA02897
gatctcgatggcttccgtcaggaagtttcccgtgagcagggtggcattccgtcctaccctcacccacacggtatgaaggacttctgggagttcccaactgtgtccatgggtcttggcccaatggatgccatttaccaggcacgtttcaaccgctacctcgaaaaccgtggcatcaaggacacctctgaccagcacgtctgggccttccttggcgacggcgaaatggacgagccagaatcacgtggtctcatccagcaggctgcactgaacaacctggacaacctgaccttcgtggttaactgcaacctgcagcgtctcgacggacctgtccgcggtaacaccaagatcatccaggaactcgagtccttcttccgtggcgcaggctggtctgtgatcaaggttgtttggggtcgcgagtgggatgaacttctggagaaggaccaggatggtgcacttgttgagatcatgaacaacacctccgatggtgactaccagaccttcaaggctaacgacggcgcatatgttcgtgagcacttcttcggacgtgacccacgcaccgcaaagctcgttgagaacatgaccgacgaagaaatctggaagcttccacgtggcggccacgattaccgcaaggtttacgcagcctacaagcgagctcttgagaccaaggatcgcccaaccgtcatccttgctcacaccattaagggctacggactcggccacaacttcgaaggccgtaacgcaacccaccagatgaagaagctgacgcttgatgatctgaagttgttccgcgacaagcagggcatcccaatcaccgatgagcagctggagaaggatccttaccttcctccttactaccacccaggtgaagacgctcctgaaatcaagtacatgaaggaacgtcgcgcagcgctcggtggctacctgccagagcgtcgtgagaactacgatccaattcaggttccaccactggataagcttcgctctgtccgtaagggctccggcaagcagcagatcgctaccaccatggcgactgttcgtaccttcaaggaactgatgcgcgataagggcttggctgatcgccttgtcccaatcattcctgatgaggcacgtaccttcggtcttgactcttggttcccaaccttgaagatctacaacccgcacggtcagaactacgtgcctgttgaccacgacctgatgctctcctaccgtgaggcacctgaaggacagatcctgcacgaaggcatcaacgaggctggttccgtggcatcgttcatcgctgcgggtacc

SEQ ID NO: 104 - protein, 429 aa, Corynebacterium glutamicum
DLDGFRQEVSREQGGIPSYPHPHGMKDFWEFPTVSMGLGPMDAIYQARFNRYLENRGIKDTSDQHVWAFLGDGEMDEPESRGLIQQAALNNLDNLTFVVNCNLQRLDGPVRGNTKIIQELESFFRGAGWSVIKVVWGREWDELLEKDQDGALVEIMNNTSDGDYQTFKANDGAYVREHFFGRDPRTAKLVENMTDEEIWKLPRGGHDYRKVYAAYKRALETKDRPTVILAHTIKGYGLGHNFEGRNATHQMKKLTLDDLKLFRDKQGIPITDEQLEKDPYLPPYYHPGEDAPEIKYMKERRAALGGYLPERRENYDPIQVPPLDKLRSVRKGSGKQQIATTMATVRTFKELMRDKGLADRLVPIIPDEARTFGLDSWFPTLKIYNPHGQNYVPVDHDLMLSYREAPEGQILHEGINEAGSVASFIAAGT

SEQ ID NO: 105 - DNA, 1133 bp, Corynebacterium glutamicum
  CDS (88)..(1110): RXN03083
attcagcagtaatcatttagacttggaaccgcttaccagtggtttcaacaatgcattcacccagctcacacgtgtggaggtgccttaatggcaaagaggatcgtaattatcggcggtggacctgcaggctatgaagccgcactcgcaggcgctaaatacggtgcagaagttaccgttattgaagatgtcggagttggcggatccgcagtcaccatggactgtgtaccttcaaagtccttcatcgctggtaccggtatcaaaaccgacctccgacgtgctgatgacatgggacttaaccgtgggcttggaaaagcacacctagaaatcgatgcactgaacatccgtgtgaaggaccttgcgaaagcacagtccgaagatatcttgggccagctgcagcgctcagatgtccgcatgattaacggtgtgggccgctttgatgattacaacaccaagcaaaccacccactacattaaagtcacccacagcgatggctccgaagaaaccgttgagtgcgatctggtgctggttgcaactggtgcaaccccccgcattcttaaaggtgcagagccagacggcgagcgcatcttgacctggcgtcaggtctacgacattgaagaactccccacccaccttatcgtggttggttccggtgtgaccggtgcggaatttgtctctgcgtttgctgaactcggcgtcaaagtcaccatggtggcatcccgtgaccgcattttgcctcacgatgacgcagatgccgcagacgtgctggaaaccgttctggctgagcgcggagtatccctggaaaagcatgcccgcgtggagtctgtcacccgcaccgaagacggtggcgtgtgtgttcgcactgctgacggacgagaaatctacggttctcacgcgttgatgactgttggttccattccaaacacggcagatcttggcctggagaacatcggtgttgagctggcaccatccggccatatcaaggttgaccggtctcccgcaccaacatccccggtgtgtacgcagcaggtgactgtactgacctattcccactggcgtccgttgcagcgatgcagggccgtatcgccatgtatcacgcactcggtgaaggcgtgagccccatccgtttgaagact

SEQ ID NO: 106 - protein, 341 aa, Corynebacterium glutamicum
MAKRIVIIGGGPAGYEAALAGAKYGAEVTVIEDVGVGGSAVTMDCVPSKSFIAGTGIKTDLRRADDMGLNRGLGKAHLEIDALNIRVKDLAKAQSEDILGQLQRSDVRMINGVGRFDDYNTKQTTHYIKVTHSDGSEETVECDLVLVATGATPRILKGAEPDGERILTWRQVYDIEELPTHLIVVGSGVTGAEFVSAFAELGVKVTMVASRDRILPHDDADAADVLETVLAERGVSLEKHARVESVTRTEDGGVCVRTADGREIYGSHALMTVGSIPNTADLGLENIGVELAPSGHIKVDRSPAPTSPVCTQQVTVLTYSHWRPLQRCRAVSPCITHSVKA

SEQ ID NO: 107 - DNA, 1518 bp, Corynebacterium glutamicum
  CDS (89)..(1495): FRXA02853
aattcagcagtaatcatttagacttggaaccgcttaccagtggtttcaacaatgcattcacccagctcacacgtgtggaggtgccttaatggcaaagaggatcgtaattatcggcggtggacctgcaggctatgaagccgcactcgcaggcgctaaatacggtgcagaagttaccgttattgaagatgtcggagttggcggatccgcagtcaccatggactgtgtaccttcaaagtccttcatcgctggtaccggtatcaaaaccgacctccgacgtgctgatgacatgggacttaaccgtgggcttggaaaagcacacctagaaatcgatgcactgaacatccgtgtgaaggaccttgcgaaagcacagtccgaagatatcttgggccagctgcagcgctcagatgtccgcatgattaacggtgtgggccgctttgatgattacaacaccaagcaaaccacccactacattaaagtcacccacagcgatggctccgaagaaaccgttgagtgcgatctggtgctggttgcaactggtgcaaccccccgcattcttaaaggtgcagagccagacggcgagcgcatcttgacctggcgtcaggtctacgacattgaagaactccccacccaccttatcgtggttggttccggtgtgaccggtgcggaatttgtctctgcgtttgctgaactcggcgtcaaagtcaccatggtggcatcccgtgaccgcattttgcctcacgatgacgcagatgccgcagacgtgctggaaaccgttctggctgagcgcggagtatccctggaaaagcatgcccgcgtggagtctgtcacccgcaccgaagacggtggcgtgtgtgttcgcactgctgacggacgagaaatctacggttctcacgcgttgatgactgttggttccattccaaacacggcagatcttggcctggagaacatcggtgttgagctggcaccatccggccatatcaaggttgaccgngtctcccgcaccaacatccccggtgtgtacgcagcaggtgactgtactgacctattcccactggcgtccgttgcagcgatgcagggccgtatcgccatgtatcacgcactcggtgaaggcgtgagccccatccgtttgaagactgttgccaccgcagtgtttacccgcccagagatcgcagcagtaggtatcacccatgcacaagttgattccggcgaagtgtctgctcgcgtgattgtgcttcctttggctactaacccacgcgccaagatgcgttccctgcgccacggttttgtgaagctgttctgccgccgtaactctggcctgatcatcggtggtgtcgtggtggcaccgaccgcgtctgagctgatcctaccgatcgctgtggcagtgaccaaccgtctgacagttgctgatctggctgataccttcgcggtgtacccatcattgtcaggttcgattactgaagcagcacgtcagctggttcaacatgatgatctaggctaatttttctgagtcttagattt

SEQ ID NO: 108 - protein, 469 aa, Corynebacterium glutamicum
MAKRIVIIGGGPAGYEAALAGAKYGAEVTVIEDVGVGGSAVTMDCVPSKSFIAGTGIKTDLRRADDMGLNRGLGKAHLEIDALNIRVKDLAKAQSEDILGQLQRSDVRMINGVGRFDDYNTKQTTHYIKVTHSDGSEETVECDLVLVATGATPRILKGAEPDGERILTWRQVYDIEELPTHLIVVGSGVTGAEFVSAFAELGVKVTMVASRDRILPHDDADAADVLETVLAERGVSLEKHARVESVTRTEDGGVCVRTADGREIYGSHALMTVGSIPNTADLGLENIGVELAPSGHIKVDRVSRTNIPGVYAAGDCTDLFPLASVAAMQGRIAMYHALGEGVSPIRLKTVATAVFTRPEIAAVGITHAQVDSGEVSARVIVLPLATNPRAKMRSLRHGFVKLFCRRNSGLIIGGVVVAPTASELILPIAVAVTNRLTVADLADTFAVYPSLSGSITEAARQLVQHDDLG

SEQ ID NO: 109 - DNA, 2895 bp, Corynebacterium glutamicum
  CDS (101)..(2872): RXA02259
atgagcccatgaaagccatcgaaatcaatcgcccagctaaacacctgttttgctgggtgattttttatctcatgcacgccaacaccctcaatgtgaaagagtgtttaaagtagttatgactgattttttacgcgatgacatcaggttcctcggtcaaatcctcggtgaggtaattgcggaacaagaaggccaggaggtttatgaactggtcgaacaagcgcgcctgacttcttttgatatcgccaagggcaacgccgaaatggatagcctggttcaggttttcgacggcattactccagccaaggcaacaccgattgctcgcgcattttcccacttcgctctgctggctaacctggcggaagacctctacgatgaagagcttcgtgaacaggctctcgatgcaggcgacacccctccggacagcactcttgatgccacctggctgaaactcaatgagggcaatgttggcgcagaagctgtggccgatgtgctgcgcaatgctgaggtggcgccggttctgactgcgcacccaactgagactcgccgccgcactgtttttgatgcgcaaaagtggatcaccacccacatgcgtgaacgccacgctttgcagtctgcggagcctaccgctcgtacgcaaagcaagttggatgagatcgagaagaacatccgccgtcgcatcaccattttgtggcagaccgcgttgattcgtgtggcccgcccacgtatcgaggacgagatcgaagtagggctgcgctactacaagctgagccttttggaagagattccacgtatcaaccgtgatgtggctgttgagcttcgtgagcgtttcggcgagggtgttcctttgaagcccgtggtcaagccaggttcctggattggtggagaccacgacggtaacccttatgtcaccgcggaaacagttgagtattccactcaccgcgctgcggaaaccgtgctcaagtactatgcacgccagctgcattccctcgagcatgagctcagcctgtcggaccgcatgaataaggtcaccccgcagctgcttgcgctggcagatgcagggcacaacgacgtgccaagccgcgtggatgagccttatcgacgcgccgtccatggcgttcgcggacgtatcctcgcgacgacggccgagctgatcggcgaggacgccgttgagggcgtgtggttcaaggtctttactccatacgcatctccggaagaattcttaaacgatgcgttgaccattgatcattctctgcgtgaatccaaggacgttctcattgccgatgatcgtttgtctgtgctgatttctgccatcgagagctttggattcaacctttacgcactggatctgcgccaaaactccgaaagctacgaggacgtcctcaccgagcttttcgaacgcgcccaagtcaccgcaaactaccgcgagctgtctgaagcagagaagcttgaggtgctgctgaaggaactgcgcagccctcgtccgctgatcccgcacggttcagatgaatacagcgaggtcaccgaccgcgagctcggcatcttccgcaccgcgtcggaggctgttaagaaattcgggccacggatggtgcctcactgcatcatctccatggcatcatcggtcaccgatgtgctcgagccgatggtgttgctcaaggaattcggactcatcgcagccaacggcgacaacccacgcggcaccgtcgatgtcatcccactgttcgaaaccatcgaagatctccaggccggcgccggaatcctcgacgaactgtggaaaattgatctctaccgcaactacctcctgcagcgcgacaacgtccaggaagtcatgctcggttactccgattccaacaaggatggcggatatttctccgcaaactgggcgctttacgacgcggaactgcagctcgtcgaactatgccgatcagccggggtcaagcttcgcctgttccacggccgtggtggcaccgtcggccgcggtggcggaccttcctacgacgcgattcttgcccagcccaggggggctgtccaaggttccgtgcgcatcaccgagcagggcgagatcatctccgctaagtacggcaaccccgaaaccgcgcgccgaaacctcgaagccctggtctcagccacgcttgaggcatcgcttctcgacgtctccgaactcaccgatcaccaacgcgcgtacgacatcatgagtgagatctctgagctcagcttgaagaagtacgcctccttggtgcacgaggatcaaggcttcatcgattacttcacccagtccacgccgctgcaggagattggatccctcaacatcggatccaggccttcctcacgcaagcagacctcctcggtggaagatttgcgagccatcccatgggtgctcagctggtcacagtctcgtgtcatgctgccaggctggtttggtgtcggaaccgcattagagcagtggattggcgaaggggagcaggccacccaacgcattgccgagctgcaaacactcaatgagtcctggccatttttcacctcagtgttggataacatggctcaggtgatgtccaaggcagagctgcgtttggcaaagctctacgcagacctgatcccagatacggaagtagccgagcgagtctattccgtcatccgcgaggagtacttcctgaccaagaagatgttctgcgtaatcaccggctctgatgatctgcttgatgacaacccacttctcgcacgctctgtccagcgccgatacccctacctgcttccactcaacgtgatccaggtagagatgatgcgacgctaccgaaaaggcgaccaaagcgagcaagtgtcccgcaacattcagctgaccatgaacggtctttccactgcgctgcgcaactccggctagtccagccggctgggtagtac

SEQ ID NO: 110 - protein, 924 aa, Corynebacterium glutamicum
VFKVVMTDFLRDDIRFLGQILGEVIAEQEGQEVYELVEQARLTSFDIAKGNAEMDSLVQVFDGITPAKATPIARAFSHFALLANLAEDLYDEELREQALDAGDTPPDSTLDATWLKLNEGNVGAEAVADVLRNAEVAPVLTAHPTETRRRTVFDAQKWITTHMRERHALQSAEPTARTQSKLDEIEKNIRRRITILWQTALIRVARPRIEDEIEVGLRYYKLSLLEEIPRINRDVAVELRERFGEGVPLKPVVKPGSWIGGDHDGNPYVTAETVEYSTHRAAETVLKYYARQLHSLEHELSLSDRMNKVTPQLLALADAGHNDVPSRVDEPYRRAVHGVRGRILATTAELIGEDAVEGVWFKVFTPYASPEEFLNDALTIDHSLRESKDVLIADDRLSVLISAIESFGFNLYALDLRQNSESYEDVLTELFERAQVTANYRELSEAEKLEVLLKELRSPRPLIPHGSDEYSEVTDRELGIFRTASEAVKKFGPRMVPHCIISMASSVTDVLEPMVLLKEFGLIAANGDNPRGTVDVIPLFETIEDLQAGAGILDELWKIDLYRNYLLQRDNVQEVMLGYSDSNKDGGYFSANWALYDAELQLVELCRSAGVKLRLFHGRGGTVGRGGGPSYDAILAQPRGAVQGSVRITEQGEIISAKYGNPETARRNLEALVSATLEASLLDVSELTDHQRAYDIMSEISELSLKKYASLVHEDQGFIDYFTQSTPLQEIGSLNIGSRPSSRKQTSSVEDLRAIPWVLSWSQSRVMLPGWFGVGTALEQWIGEGEQATQRIAELQTLNESWPFFTSVLDNMAQVMSKAELRLAKLYADLIPDTEVAERVYSVIREEYFLTKKMFCVITGSDDLLDDNPLLARSVQRRYPYLLPLNVIQVEMMRRYRKGDQSEQVSRNIQLTMNGLSTALRNSG

SEQ ID NO: 111 - DNA, 939 bp, Corynebacterium glutamicum
  CDS (101)..(916): RXN02326
ccaggcggacagttgtccaacctgcgtgcacaggccaccgcactgggccttgcggatcgtttcgaactcatcgaagacaactacgcaagccgttaatgagatgctgggacgcccaaccaaggtcaccccatcctccaaggttgttggcgacctcgcactccacctcgttggtgcgggtgtggatccagcagactttgctgccgatccacaaaagtacgacatcccagactctgtcatcgcgttcctgcgcggcgagcttggtaaccctccaggtggctggccagagccactgcgcacccgcgcactggaaggccgctccgaaggcaaggcacctctgacggaagttcctgaggaagagcaggcgcacctcgacgctgatgattccaaggaacgtcgcaatagcctcaaccgcctgctgttcccgaagccaaccgaagagttcctcgagcaccgtcgccgcttcggcaacacctctgcgctggatgatcgtgaattcttctacggcctggtcgaaggccgcgagactttgatccgcctgccagatgtgcgcaccccactgcttgttcgcctggatgcgatctctgagccagacgataagggtatgcgcaatgttgtggccaacgtcaacggccagatccgcccaatgcgtgtgcgtgaccgctccgttgagtctgtcaccgcaaccgcagaaaaggcagattcctccaacaagggccatgttgctgcaccattcgctggtgttgtcaccgtgactgttgctgaaggtgatgaggtcaaggctggagatgcagtcgcaatcatcgaggctatgaagatggaagcaacaatcactgcttctgttgacggcaaaatcgatcgcgttgtggttcctgctgcaacgaaggtggaaggtggcgacttgatcgtcgtcgtttcctaaacctttctgtaaaaagcccc

SEQ ID NO: 112 - protein, 272 aa, Corynebacterium glutamicum
MLGRPTKVTPSSKVVGDLALHLVGAGVDPADFAADPQKYDIPDSVIAFLRGELGNPPGGWPEPLRTRALEGRSEGKAPLTEVPEEEQAHLDADDSKERRNSLNRLLFPKPTEEFLEHRRRFGNTSALDDREFFYGLVEGRETLIRLPDVRTPLLVRLDAISEPDDKGMRNVVANVNGQIRPMRVRDRSVESVTATAEKADSSNKGHVAAPFAGVVTVTVAEGDEVKAGDAVAIIEAMKMEATITASVDGKIDRVVVPAATKVEGGDLIVVVS

SEQ ID NO: 113 - DNA, 939 bp, Corynebacterium glutamicum; identical to SEQ ID NO: 111
  CDS (101)..(916): FRXA02326

SEQ ID NO: 114 - protein, 272 aa, Corynebacterium glutamicum; identical to SEQ ID NO: 112

SEQ ID NO: 115 - DNA, 1083 bp, Corynebacterium glutamicum
  CDS (101)..(1060): RXN02327
accgctgaagcagcttggcccagccgcgtttgctcgtgatctccgtgagcaggacgcactggcagttactgataccaccttccgcgatgcacaccagtctttgcttgcgacccgagtccgctcattcgcactgaagcctgcggcagaggccgtcgcaaagctgactcctgagcttttgtccgtggaggcctggggcggcgcgacctacgatgtggcgatgcgtttcctctttgaggatccgtgggacaggctcgacgagctgcgcgaggcgatgccgaatgtaaacattcagatgctgcttcgcggccgcaacaccgtgggatacaccccgtacccagactccgtctgccgcgcgtttgttaaggaagctgccagctccggcgtggacatcttccgcatcttcgacgcgcttaacgacgtctcccagatgcgtccagcaatcgacgcagtcctggagaccaacaccgcggtagccgaggtggctatggcttattctggtgatctctctgatccaaatgaaaagctctacaccctggattactacctaaagatggcagaggagatcgtcaagtctggcgctcacatcttggccattaaggatatggctggtctgcttcgcccagctgcggtaaccaagctggtcaccgcactgcgccgtgaattcgatctgccagtgcacgtgcacacccacgacactgcgggtggccagctggcaacctactttgctgcagctcaagctggtgcagatgctgttgacggtgcttccggcaccactgtctggcaccacctcccaagccatcccttgtctgccattgttgctgcattcgcgcacacccgtcgcgataccggtttgagcctcgaggctgtttctgacctcgagccgtactgggaagcagtgcgcggactgtacctgccatttgagtctggaaccccaggcccaaccggtcgcgtctaccgccacgaaatcccaggcggacagttgtccaacctgcgtgcacaggccaccgcactgggccttgcggatcgtttcgaactcatcgaagacaactacgcaagccgttaatgagatgctgggacgcccaa

SEQ ID NO: 116 - protein, 320 aa, Corynebacterium glutamicum
LLATRVRSFALKPAAEAVAKLTPELLSVEAWGGATYDVAMRFLFEDPWDRLDELREAMPNVNIQMLLRGRNTVGYTPYPDSVCRAFVKEAASSGVDIFRIFDALNDVSQMRPAIDAVLETNTAVAEVAMAYSGDLSDPNEKLYTLDYYLKMAEEIVKSGAHILAIKDMAGLLRPAAVTKLVTALRREFDLPVHVHTHDTAGGQLATYFAAAQAGADAVDGASGTTVWHHLPSHPLSAIVAAFAHTRRDTGLSLEAVSDLEPYWEAVRGLYLPFESGTPGPTGRVYRHEIPGGQLSNLRAQATALGLADRFELIEDNYASR

SEQ ID NO: 117 - DNA, 1083 bp, Corynebacterium glutamicum; identical to SEQ ID NO: 115
  CDS (101)..(1060): FRXA02327

SEQ ID NO: 118 - protein, 320 aa, Corynebacterium glutamicum; identical to SEQ ID NO: 116

SEQ ID NO: 119 - DNA, 1719 bp, Corynebacterium glutamicum
  CDS (101)..(1696): RXN02328
gaagtcgtgcaggtcaggggagtgttgcccgaaaacattgagaggaaaacaaaaaccgatgtttgattgggggaatcgggggttacgatactaggacgcagtgactgctatcacccttggcggtctcttgttgaaaggaataattactctagtgtcgactcacacatcttcaacgcttccagcattcaaaaagatcttggtagcaaaccgcggcgaaatcgcggtccgtgctttccgtgcagcactcgaaaccggtgcagccacggtagctatttacccccgtgaagatcggggatcattccaccgctcttttgcttctgaagctgtccgcattggtaccgaaggctcaccagtcaaggcgtacctggacatcgatgaaattatcggtgcagctaaaaaagttaaagcagatgccatttacccgggatacggcttcctgtctgaaaatgcccagcttgcccgcgagtgtgcggaaaacggcattacttttattggcccaaccccagaggttcttgatctcaccggtgataagtctcgcgcggtaaccgccgcgaagaaggctggtctgccagttttggcggaatccaccccgagcaaaaacatcgatgagatcgttaaaagcgctgaaggccagacttaccccatctttgtgaaggcagttgccggtggtggcggacgcggtatgcgttttgttgcttcacctgatgagcttcgcaaattagcaacagaagcatctcgtgaagctgaagcggctttcggcgatggcgcggtatatgtcgaacgtgctgtgattaaccctcagcatattgaagtgcagatccttggcgatcacactggagaagttgtacacctttatgaacgtgactgctcactgcagcgtcgtcaccaaaaagttgtcgaaattgcgccagcacagcatttggatccagaactgcgtgatcgcatttgtgcggatgcagtaaagttctgccgctccattggttaccagggcgcgggaaccgtggaattcttggtcgatgaaaagggcaaccacgtcttcatcgaaatgaacccacgtatccaggttgagcacaccgtgactgaagaagtcaccgaggtggacctggtgaaggcgcagatgcgcttggctgctggtgcaaccttgaaggaattgggtctgacccaagataagatcaagacccacggtgcagcactgcagtgccgcatcaccacggaagatccaaacaacggcttccgcccagataccggaactatcaccgcgtaccgctcaccaggcggagctggcgttcgtcttgacggtgcagctcagctcggtggcgaaatcaccgcacactttgactccatgctggtgaaaatgacctgccgtggttccgactttgaaactgctgttgctcgtgcacagcgcgcgttggctgagttcaccgtgtctggtgttgcaaccaacattggtttcttgcgtgcgttgctgcgggaagaggacttcacttccaagcgcatcgccaccggattcattgccgatcacccgcacctccttcaggctccacctgctgatgatgagcagggacgcatcctggattacttggcagatgtcaccgtgaacaagcctcatggtgtgcgtccaaaggatgttgcagctcctatcgataagctgcctaacatcaaggatctgccactgccacgcggttcccgtgaccgctgaagcagcttggcccagccgcg

SEQ ID NO: 120 - protein, 532 aa, Corynebacterium glutamicum
VTAITLGGLLLKGIITLVSTHTSSTLPAFKKILVANRGEIAVRAFRAALETGAATVAIYPREDRGSFHRSFASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDEIVKSAEGQTYPIFVKAVAGGGGRGMRFVASPDELRKLATEASREAEAAFGDGAVYVERAVINPQHIEVQILGDHTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIADHPHLLQAPPADDEQGRILDYLADVTVNKPHGVRPKDVAAPIDKLPNIKDLPLPRGSRDR

SEQ ID NO: 121 - DNA, 1406 bp, Corynebacterium glutamicum
  CDS (1)..(1383): FRXA02328
gcttctgaagctgtccgcattggtaccgaaggctcaccagtcaaggcgtacctggacatcgatgaaattatcggtgcagctaaaaaagttaaagcagatgccatttacccgggatacggcttcctgtctgaaaatgcccagcttgcccgcgagtgtgcggaaaacggcattacttttattggcccaaccccagaggttcttgatctcaccggtgataagtctcgcgcggtaaccgccgcgaagaaggctggtctgccagttttggcggaatccaccccgagcaaaaacatcgatgagatcgttaaaagcgctgaaggccagacttaccccatctttgtgaaggcagttgccggtggtggcggacgcggtatgcgttttgttgcttcacctgatgagcttcgcaaattagcaacagaagcatctcgtgaagctgaagcggctttcggcgatggcgcggtatatgtcgaacgtgctgtgattaaccctcagcatattgaagtgcagatccttggcgatcacactggagaagttgtacacctttatgaacgtgactgctcactgcagcgtcgtcaccaaaaagttgtcgaaattgcgccagcacagcatttggatccagaactgcgtgatcgcatttgtgcggatgcagtaaagttctgccgctccattggttaccagggcgcgggaaccgtggaattcttggtcgatgaaaagggcaaccacgtcttcatcgaaatgaacccacgtatccaggttgagcacaccgtgactgaagaagtcaccgaggtggacctggtgaaggcgcagatgcgcttggctgctggtgcaaccttgaaggaattgggtctgacccaagataagatcaagacccacggtgcagcactgcagtgccgcatcaccacggaagatccaaacaacggcttccgcccagataccggaactatcaccgcgtaccgctcaccaggcggagctggcgttcgtcttgacggtgcagctcagctcggtggcgaaatcaccgcacactttgactccatgctggtgaaaatgacctgccgtggttccgactttgaaactgctgttgctcgtgcacagcgcgcgttggctgagttcaccgtgtctggtgttgcaaccaacattggtttcttgcgtgcgttgctgcgggaagaggacttcacttccaagcgcatcgccaccggattcattgccgatcacccgcacctccttcaggctccacctgctgatgatgagcagggacgcatcctggattacttggcagatgtcaccgtgaacaagcctcatggtgtgcgtccaaaggatgttgcagctcctatcgataagctgcctaacatcaaggatctgccactgccacgcggttcccgtgaccgctgaagcagcttggcccagccgcg

SEQ ID NO: 122 - protein, 461 aa, Corynebacterium glutamicum
ASEAVRIGTEGSPVKAYLDIDEIIGAAKKVKADAIYPGYGFLSENAQLARECAENGITFIGPTPEVLDLTGDKSRAVTAAKKAGLPVLAESTPSKNIDEIVKSAEGQTYPIFVKAVAGGGGRGMRFVASPDELRKLATEASREAEAAFGDGAVYVERAVINPQHIEVQILGDHTGEVVHLYERDCSLQRRHQKVVEIAPAQHLDPELRDRICADAVKFCRSIGYQGAGTVEFLVDEKGNHVFIEMNPRIQVEHTVTEEVTEVDLVKAQMRLAAGATLKELGLTQDKIKTHGAALQCRITTEDPNNGFRPDTGTITAYRSPGGAGVRLDGAAQLGGEITAHFDSMLVKMTCRGSDFETAVARAQRALAEFTVSGVATNIGFLRALLREEDFTSKRIATGFIADHPHLLQAPPADDEQGRILDYLADVTVNKPHGVRPKDVAAPIDKLPNIKDLPLPRGSRDR

SEQ ID NO: 123 - DNA, 1347 bp, Corynebacterium glutamicum
  CDS (101)..(1324): RXN01048
agctacagatttagctagtgtttttgttccagaaccctaaatgaggttctacccttaacagagcttcccgcaaaaacaccgattaacaaggctaaatgatatgaccatcgacctgcagcgttccacccaaaacctcacccatgaggaaatcttcgaggcacacgagggcggaaagctctccattagttccactcgtccgctccgcgacatgcgcgatctttcccttgcttacacccctggtgttgctcaggtttgtgaagcaatcaaggaagatccagaggttgcgcgcacccacacgggcattggaaacaccgtcgcggttatttccgacggcaccgctgttcttggccttggcgatatcggacctcaggcctcccttcccgtcatggagggcaaggctcagctgtttagctctttcgctggcctgaaggctatccctatcgttttggacgttcacgatgttgacgctttggttgagaccatcgcagccatcgcgccttctttcggtgctatcaacttggaggacatctccgctcctcgttgcttcgaggtggagcgccgcctcatcgagcgtctcgatattccagttatgcacgatgaccagcacggcaccgctgtggttatcctcgctgcgctgcgcaactccctgaagctgctggatcgcaagatcgaagacctcaagattgttatttccggcgcaggcgcagcgggcgttgcagctgtagatatgctgaccaacgctggagcaaccgacatcgtggttcttgattcccgaggcatcatccacgacagccgtgaggatctttccccagttaaggctgctcttgcagagaagaccaaccctcgtggcatcagcggtggcatcaatgaggctttcaccggcgcggacctgttcattggcgtgtccggcggcaacatcggcgaggacgctctcaaactcatggccccggagccaatcctgttcaccctggcgaacccaaccccagagatcgatcctgagctgtctcagaagtacggcgccatcgtcgcgaccgggcgctctgacctgcctaaccagatcaacaacgtgctggcgttcccaggaattttcgccggcgctctcgcagccaaggctaagaagatcacccccgagatgaagctcgccgctcagaggcaatcgcagacatcgcagctgaggacctcgaggtcggccgcatcgtgcctaccgccctggatccccgcgttgccccaacagtcaaggcagctgtccaggccgtcgccaaagcgcaaaacgcttaaaaatttgcttatcgacgcctccctccccgtcgaggcgccaatattttaagagcaaacttgaggcccaca

SEQ ID NO: 124 - protein, 408 aa, Corynebacterium glutamicum
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKAALAEKTNPRGISGGINEAFTGADLFIGVSGGNIGEDALKLMAPEPILFTLANPTPEIDPELSQKYGAIVATGRSDLPNQINNVLAFPGIFAGALAAKAKKITPEMKLAAQRQSQTSQLRTSRSAASCLPPWIPALPQQSRQLSRPSPKRKTLKNLLIDASLPVEAPIF

SEQ ID NO: 125 - DNA, 311 bp, Corynebacterium glutamicum
  CDS (1)..(288): FRXA01048
cgctctgacttgcctaaccagatcaacaacgtgctggcgttcccaggaattttcgccggcgctctcgcagccaaggctaagaagatcacccccgagatgaagctcgccgctcagaggcaatcgcagacatcgcagctgaggacctcgaggtcggccgcatcgtgcctaccgccctggatccccgcgttgccccaacagtcaaggcagctgtccaggccgtcgccaaagcgcaaaacgcttaaaaatttgcttatcgacgcctccctccccgtcgaggcgccaatattttaagagcaaacttgaggcccaca

SEQ ID NO: 126 - protein, 96 aa, Corynebacterium glutamicum
RSDLPNQINNVLAFPGIFAGALAAKAKKITPEMKLAAQRQSQTSQLRTSRSAASCLPPWIPALPQQSRQLSRPSPKRKTLKNLLIDASLPVEAPIF

SEQ ID NO: 127 - DNA, 1063 bp, Corynebacterium glutamicum
  CDS (101)..(1063): FRXA00290
agctacagatttagctagtgtttttgttccagaaccctaaatgaggttctacccttaacagagcttcccgcaaaaacaccgattaacaaggctaaatgatatgaccatcgacctgcagcgttccacccaaaacctcacccatgaggaaatcttcgaggcacacgagggcggaaagctctccattagttccactcgtccgctccgcgacatgcgcgatctttcccttgcttacacccctggtgttgctcaggtttgtgaagcaatcaaggaagatccagaggttgcgcgcacccacacgggcattggaaacaccgtcgcggttatttccgacggcaccgctgttcttggccttggcgatatcggacctcaggcctcccttcccgtcatggagggcaaggctcagctgtttagctctttcgctggcctgaaggctatccctatcgttttggacgttcacgatgttgacgctttggttgagaccatcgcagccatcgcgccttctttcggtgctatcaacttggaggacatctccgctcctcgttgcttcgaggtggagcgccgcctcatcgagcgtctcgatattccagttatgcacgatgaccagcacggcaccgctgtggttatcctcgctgcgctgcgcaactccctgaagctgctggatcgcaagatcgaagacctcaagattgttatttccggcgcaggcgcagcgggcgttgcagctgtagatatgctgaccaacgctggagcaaccgacatcgtggttcttgattcccgaggcatcatccacgacagccgtgaggatctttccccagttaaggctgctcttgcagagaagaccaaccctcgtggcatcagcggtggcatcaatgaggctttcaccggcgcggacctgttcattggcgtgtccggcggcaacatcggcgaggacgctctcaaactcatggccccggagccaatcctgttcaccctggcgaacccaaccccagagatcgatcctgagctgtctcagaagtacggcgccatcgtcgcgaccgggccggtcttgacctgcctaaccagatca

SEQ ID NO: 128 - protein, 321 aa, Corynebacterium glutamicum
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKAALAEKTNPRGISGGINEAFTGADLFIGVSGGNIGEDALKLMAPEPILFTLANPTPEIDPELSQKYGAIVATGPVLTCLTRS

SEQ ID NO: 129 - DNA, 1065 bp, Corynebacterium glutamicum
  CDS (101)..(1042): RXA02694
attaaaggtgtaacaaaggaatccgggcacaagctcttgctgattttctgagctgctttgtgggttgtccggttagggaaatcaggaagtgggatcgaaaatgaaagaaaccgtcggtaacaagattgtcctcattggcgcaggagatgttggagttgcatacgcatacgcactgatcaaccagggcatggcagatcaccttgcgatcatcgacatcgatgaaaagaaactcgaaggcaacgtcatggacttaaaccatggtgttgtgtgggccgattcccgcacccgcgtcaccaagggcacctacgctgactgcgaagacgcagccatggttgtcatttgtgccggcgcagcccaaaagccaggcgagacccgcctccagctggtggacaaaaacgtcaagattatgaaatccatcgtcggcgatgtcatggacagcggattcgacggcatcttcctcgtggcgtccaacccagtggatatcctgacctacgcagtgtggaaattctccggcttggaatggaaccgcgtgatcggctccggaactgtcctggactccgctcgattccgctacatgctgggcgaactctacgaagtggcaccaagctccgtccacgcctacatcatcggcgaacacggcgacactgaacttccagtcctgtcctccgcgaccatcgcaggcgtatcgcttagccgaatgctggacaaagacccagagcttgagggccgtctagagaaaattttcgaagacacccgcgacgctgcctatcacattatcgacgccaagggctccacttcctacggcatcggcatgggtcttgctcgcatcacccgcgcaatcctacagaaccaagacgttgcagtcccagtctctgcactgctccacggtgaatacggtgaggaagacatctacatcggcaccccagctgtggtgaaccgccgaggcatccgccgcgttgtcgaactagaaatcaccgaccacgagatggaacgcttcaagcattccgcaaataccctgcgcgaaattcagaagcagttcttctaaatctttggcgcctagttggc

SEQ ID NO: 130 - protein, 314 aa, Corynebacterium glutamicum
MKETVGNKIVLIGAGDVGVAYAYALINQGMADHLAIIDIDEKKLEGNVMDLNHGVVWADSRTRVTKGTYADCEDAAMVVICAGAAQKPGETRLQLVDKNVKIMKSIVGDVMDSGFDGIFLVASNPVDILTYAVWKFSGLEWNRVIGSGTVLDSARFRYMLGELYEVAPSSVHAYIIGEHGDTELPVLSSATIAGVSLSRMLDKDPELEGRLEKIFEDTRDAAYHIIDAKGSTSYGIGMGLARITRAILQNQDVAVPVSALLHGEYGEEDIYIGTPAVVNRRGIRRVVELEITDHEMERFKHSANTLREIQKQFF

SEQ ID NO: 131 - DNA, 2967 bp, Corynebacterium glutamicum
  CDS (101)..(2944): RXN00296
tttttgttggcatgtctgacattatcgcacaattcaccacagtaaccggtaacatgttactcaaagcccgcttggatcgaatttcacaaaaggacccaccatgactcacaccatcaaattcaacagactcgacccagaagtatttagccagcattctcgcgcgaagctgcgcacggatatgacaacccgtgcagcatattcttctgatgcaggaatttttagacgcgtccctgcagctgtagctgaaccagaaaatgtggaacaaattcgtgatgccattgctgttgcggtggcacgagggtggtctgttgttgggcgcggtggaggaagctcggttgctggaaatgcgatcggtgaaggtttgatcatcgatacgtcacgctatttcaaccgcattttagatattgatccagttgcacaaactgcagttgtggaacccggtgtggtgtgtgatgccttgcgcgatgcagccgcagaattcggattaacttacggcccggatccttccacgcattcccggtgcacgatcggtggcatggttgccaacaatgcgtgtggttcacactcggttgcattcggtacagctgcggaaaatctcgtggatgtcacgctcatgctcagcgatggccgagaagtcactgtgacaaaagatggctgcgatgatgctgagatcaatcagaagctcaccgacttagcgtccaagaatcaggaccttattagtaaagaactgggtcgtttccctcgccaagtgtcgggctacggtttgcattatcttgcccacgacatggccaaagcaatggcgggcaccgagggaaccattggaatcattactcggttgacggtgaagttggttccaacacccaaagtgaaagcgcttgctgtcctggctttcgacacggtttttgacgccgcccgagcagccgccaaattgcgactgcctggggtagcaaccattgaaggcatgggcggagatctcctcgctgcgctgcgcagtaaacagggacaatcagaagctgggcagaatcttccaggaaaccgcatcggcattgaagccggcggatggttgtactgcgagacaggaagtgacaccctgcaggccgcggtacaagccgccgaggaagtcgcaaccgccgttgacaccattgattacgtggtcgtgtctgagccttctgaaatgcgggaattgtggcgcatccgtgaatcctcggcgggcattgtcacgcgcttagctgatggtggggaagcgtggccgaattgggaagactcggcggtgcctccagagaatttagctgattatctccgcgatctttatgcgctgatggataagttcgattaccagggtattccatttggacactttggagaaggctgcgtccacgttcgcatcagttttgatttctctaccaaggaaggcctgaagaaattcgaggcgttcatgaatgaagcctccaccttggtggcgtcttatggtggcagcctctcgggcgagcatggagacggtcgcgcccgctcatccttccttgaccgcatgtattcagcagaaatgcgtgcactcttcgaagaattcaagctgattttcgatccccagcgcatcttcaatccgggagtgttggtctgggcagatcctgtcatgcaaggacttcgcatggacccgggccagcgcgccctcgacatcacgcccgtacacaaattctctaaagacaaaggttccatgatcaacgcggtgaatcgctgcgtgggtgtatccgcatgccgctcagaatccgacgcgatgtgcccgtccttccaaatcaccggcgacgaagtacattccaccagaggccgcgcccgcttgctctctgagatgttccgcggtgaatccatcgccgacggctaccgcagcgaagaagtcaatgaagcccttgacctgtgcctttcctgcaaagcatgcgcatcggaatgtccagtcaacgtcgacatgtccacctacaaagccgaattcctggacaaacactacgccggccgacttcgccccatggcccattacgtcatgggctggctgccgcttctgggacacgttgcccataaaataccgcttcttcctacgcttatcgacgccaccatgcagtcagcactcaccgccccagtggtgcgcaaggtcggcgggctcgctgatcgcccgttgatttccttcgcccaccgctcgctgcgcaagtacaagccgaagaaaaactcaggtgaaacggtggtgctgtggcccgattccttcaacaccaacctcgacaccggaccagctcacgcagcgatcaaaactcttgaagccctcggttacaacgtggtcatcccagatggcttcgtctgctgtggactcacctggcattccaccggccaattgagcatgacaaagaaagtcctagaacaaacggcgaaagtgatgaaaccctacctggaccaaggtctaacagtcgttggtttggaaccttcgtgcaccgtcatgcttcaagatgaggcaacagaactctccgataaccctgatctggcacgccttgcagcactgaccaaaccattcgctgaggtcatcgcaccaaagatcaccgagctagtcgagtctggaagcctccagctaacagaatcaactgcgcttacccaggtgcactgccacgagcgttcgctaggcgacccacaacaatcggcactcgttcttgaagctttgggtgtaaaagatgaacaaattgccactggttgttgcgggcttgccggaaactggggctttgaaaaagaccacgctgaaatgtccttcgcacttggtgaacgagagctgttccccaaggtcagaaaagcagaaggacatgtgattgctgacggtttctcctgccgcacccagatcgaacaaggcaccggaaaacaagcaacgcaccttgcagaggtggtcttaagcatcttggagcaaaacaacatggcacaataacgatcatgcaacaggtgctc

SEQ ID NO: 132 - protein, 948 aa, Corynebacterium glutamicum
MTHTIKFNRLDPEVFSQHSRAKLRTDMTTRAAYSSDAGIFRRVPAAVAEPENVEQIRDAIAVAVARGWSVVGRGGGSSVAGNAIGEGLIIDTSRYFNRILDIDPVAQTAVVEPGVVCDALRDAAAEFGLTYGPDPSTHSRCTIGGMVANNACGSHSVAFGTAAENLVDVTLMLSDGREVTVTKDGCDDAEINQKLTDLASKNQDLISKELGRFPRQVSGYGLHYLAHDMAKAMAGTEGTIGIITRLTVKLVPTPKVKALAVLAFDTVFDAARAAAKLRLPGVATIEGMGGDLLAALRSKQGQSEAGQNLPGNRIGIEAGGWLYCETGSDTLQAAVQAAEEVATAVDTIDYVVVSEPSEMRELWRIRESSAGIVTRLADGGEAWPNWEDSAVPPENLADYLRDLYALMDKFDYQGIPFGHFGEGCVHVRISFDFSTKEGLKKFEAFMNEASTLVASYGGSLSGEHGDGRARSSFLDRMYSAEMRALFEEFKLIFDPQRIFNPGVLVWADPVMQGLRMDPGQRALDITPVHKFSKDKGSMINAVNRCVGVSACRSESDAMCPSFQITGDEVHSTRGRARLLSEMFRGESIADGYRSEEVNEALDLCLSCKACASECPVNVDMSTYKAEFLDKHYAGRLRPMAHYVMGWLPLLGHVAHKIPLLPTLIDATMQSALTAPVVRKVGGLADRPLISFAHRSLRKYKPKKNSGETVVLWPDSFNTNLDTGPAHAAIKTLEALGYNVVIPDGFVCCGLTWHSTGQLSMTKKVLEQTAKVMKPYLDQGLTVVGLEPSCTVMLQDEATELSDNPDLARLAALTKPFAEVIAPKITELVESGSLQLTESTALTQVHCHERSLGDPQQSALVLEALGVKDEQIATGCCGLAGNWGFEKDHAEMSFALGERELFPKVRKAEGHVIADGFSCRTQIEQGTGKQATHLAEVVLSILEQNNMAQ

SEQ ID NO: 133 - DNA, 2858 bp, Corynebacterium glutamicum
  CDS (1)..(2835): FRXA00296
accatcaaattcaacagactcgacccagaagtatttagccagcattctcgcgcgaagctgcgcacggatatgacaacccgtgcagcatattcttctgatgcaggaatttttagacgcgtccctgcagctgtagctgaaccagaaaatgtggaacaaattcgtgatgccattgctgttgcggtggcacgagggtggtctgttgttgggcgcggtggaggaagctcggttgctggaaatgcgatcggtgaaggtttgatcatcgatacgtcacgctatttcaaccgcattttagatattgatccagttgcacaaactgcagttgtggaacccggtgtggtgtgtgatgccttgcgcgatgcagccgcagaattcggattaacttacggcccggatccttccacgcattcccggtgcacgatcggtggcatggttgccaacaatgcgtgtggttcacactcggttgcattcggtacagctgcggaaaatctcgtggatgtcacgctcatgctcagcgatggccgagaagtcactgtgacaaaagatggctgcgatgatgctgagatcaatcagaagctcaccgacttagcgtccaagaatcaggaccttattagtaaagaactgggtcgtttccctcgccaagtgtcgggctacggtttgcattatcttgcccacgacatggccaaagcaatggcgggcaccgagggaaccattggaatcattactcggttgacggtgaagttggttccaacacccaaagtgaaagcgcttgctgtcctggctttcgacacggtttttgacgccgcccgagcagccgccaaattgcgactgcctggggtagcaaccattgaaggcatgggcggagatctcctcgctgcgctgcgcagtaaacagggacaatcagaagctgggcagaatcttccaggaaaccgcatcggcattgaagccggcggatggttgtactgcgagacaggaagtgacaccctgcaggccgcggtacaagccgccgaggaagtcgcaaccgccgttgacaccattgattacgtggtcgtgtctgagccttctgaaatgcgggaattgtggcgcatccgtgaatcctcggcgggcattgtcacgcgcttagctgatggtggggaagcgtggccgaattgggaagactcggcggtgcctccagagaatttagctgattatctccgcgatctttatgcgctgatggataagttcgattaccagggtattccatttggacactttggagaaggctgcgtccacgttcgcatcagttttgatttctctaccaaggaaggcctgaagaaattcgaggcgttcatgaatgaagcctccaccttggtggcgtcttatggtggcagcctctcgggcgagcatggagacggtcgcgcccgctcatccttccttgaccgcatgtattcagcagaaatgcgtgcactcttcgaagaattcaagctgattttcgatccccagcgcatcttcaatccgggagtgttggtctgggcagatcctgtcatgcaaggacttcgcatggacccgggccagcgcgccctcgacatcacgcccgtacacaaattctctaaagacaaaggttccatgatcaacgcggtgaatcgctgcgtgggtgtatccgcatgccgctcagaatccgacgcgatgtgcccgtccttccaaatcaccggcgacgaagtacattccaccagaggccgcgcccgcttgctctctgagatgttccgcggtgaatccatcgccgacggctaccgcagcgaagaagtcaatgaagcccttgacctgtgcctttcctgcaaagcatgcgcatcggaatgtccagtcaacgtcgacatgtccacctacaaagccgaattcctggacaaacactacgccggccgacttcgccccatggcccattacgtcatgggctggctgccgcttctgggacacgttgcccataaaataccgcttcttcctacgcttatcgacgccaccatgcagtcagcactcaccgccccagtggtgcgcaaggtcggcgggctcgctgatcgcccgttgatttccttcgcccaccgctcgctgcgcaagtacaagccgaagaaaaactcaggtgaaacggtggtgctgtggcccgattccttcaacaccaacctcgacaccggaccagctcacgcagcgatcaaaactcttgaagccctcggttacaacgtggtcatcccagatggcttcgtctgctgtggactcacctggcattccaccggccaattgagcatgacaaagaaagtcctagaacaaacggcgaaagtgatgaaaccctacctggaccaaggtctaacagtcgttggtttggaaccttcgtgcaccgtcatgcttcaagatgaggcaacagaactctccgataaccctgatctggcacgccttgcagcactgaccaaaccattcgctgaggtcatcgcaccaaagatcaccgagctagtcgagtctggaagcctccagctaacagaatcaactgcgcttacccaggtgcactgccacgagcgttcgctaggcgacccacaacaatcggcactcgttcttgaagctttgggtgtaaaagatgaacaaattgccactggttgttgcgggcttgccggaaactggggctttgaaaaagaccacgctgaaatgtccttcgcacttggtgaacgagagctgttccccaaggtcagaaaagcagaaggacatgtgattgctgacggtttctcctgccgcacccagatcgaacaaggcaccggaaaacaagcaacgcaccttgcagaggtggtcttaagcatcttggagcaaaacaacatggcacaataacgatcatgcaacaggtgctc

SEQ ID NO: 134 - protein, 945 aa, Corynebacterium glutamicum
TIKFNRLDPEVFSQHSRAKLRTDMTTRAAYSSDAGIFRRVPAAVAEPENVEQIRDAIAVAVARGWSVVGRGGGSSVAGNAIGEGLIIDTSRYFNRILDIDPVAQTAVVEPGVVCDALRDAAAEFGLTYGPDPSTHSRCTIGGMVANNACGSHSVAFGTAAENLVDVTLMLSDGREVTVTKDGCDDAEINQKLTDLASKNQDLISKELGRFPRQVSGYGLHYLAHDMAKAMAGTEGTIGIITRLTVKLVPTPKVKALAVLAFDTVFDAARAAAKLRLPGVATIEGMGGDLLAALRSKQGQSEAGQNLPGNRIGIEAGGWLYCETGSDTLQAAVQAAEEVATAVDTIDYVVVSEPSEMRELWRIRESSAGIVTRLADGGEAWPNWEDSAVPPENLADYLRDLYALMDKFDYQGIPFGHFGEGCVHVRISFDFSTKEGLKKFEAFMNEASTLVASYGGSLSGEHGDGRARSSFLDRMYSAEMRALFEEFKLIFDPQRIFNPGVLVWADPVMQGLRMDPGQRALDITPVHKFSKDKGSMINAVNRCVGVSACRSESDAMCPSFQITGDEVHSTRGRARLLSEMFRGESIADGYRSEEVNEALDLCLSCKACASECPVNVDMSTYKAEFLDKHYAGRLRPMAHYVMGWLPLLGHVAHKIPLLPTLIDATMQSALTAPVVRKVGGLADRPLISFAHRSLRKYKPKKNSGETVVLWPDSFNTNLDTGPAHAAIKTLEALGYNVVIPDGFVCCGLTWHSTGQLSMTKKVLEQTAKVMKPYLDQGLTVVGLEPSCTVMLQDEATELSDNPDLARLAALTKPFAEVIAPKITELVESGSLQLTESTALTQVHCHERSLGDPQQSALVLEALGVKDEQIATGCCGLAGNWGFEKDHAEMSFALGERELFPKVRKAEGHVIADGFSCRTQIEQGTGKQATHLAEVVLSILEQNNMAQ

SEQ ID NO: 135 - DNA, 1383 bp, Corynebacterium glutamicum
  CDS (101)..(1360): RXA01901
gcatgttgccttctctctgtgatcgcctcgttcttcatccaacgcgtcgcgcaccaagagaactaaaatctaagtaaaacccctccgaaaggaaccacccatggtgaaacgtcaactgcccaaccccgcagaactactcgaactcatgaagttcaaaaagccagagctcaacggcaagaaacgacgcctagactccgcgctcaccatctacgacctgcgtaaaattgctaaacgacgcaccccagctgccgcgttcgactacaccgacggcgcagccgaggccgaactctcaatcacacgcgcacgtgaagcattcgaaaacatcgaattccacccagacatcctcaagcctgcagaacacgtagacaccaccacccaaatcctgggcggaacctcctccatgccattcggcatcgcaccaaccggcttcacccgcctcatgcagaccgaaggtgaaatcgcaggtgccggagctgcaggcgctgcaggaattcctttcaccctgtccaccctgggcactacctccatcgaagacgtcaaggccaccaaccccaacggccgaaactggttccagctctacgtcatgcgcgaccgcgaaatctcctacggcctcgtcgaacgcgcagccaaagcaggattcgacaccctgatgttcaccgtggatacccccatcgccggctaccgcatccgcgattcccgcaacggattctccatcccgccacagctgaccccatccaccgtgctcaatgcaatcccacgcccatggtggtggatcgacttcctgaccaccccaacccttgagttcgcatccctttcctcgaccggcggaaccgtgggcgacctcctcaactccgcgatggatcccaccatttcttacgaagacctcaaggtcatccgtgaaatgtggccaggcaagctcgtagtcaagggtgtccagaacgttgaagactccgtcaaactcctcgaccaaggcgtcgacggcctcatcctctccaaccacggtggccgtcaactcgaccgcgcaccagtcccattccacctcctgccacaggtacgcaaggaagtcggatctgaaccaaccatcatgatcgacaccggcatcatgaacggcgccgacatcgtcgcagccgtagccatgggcgctgacttcaccctcatcggtcgtgcctacctctacggactcatggccggaggccgcgaaggcgtcgaccgcaccatcgccattctccgcagcgagatcacccgcaccatggctctcctcggtgtttcctccctcgaagaactcgagccacgccacgtcacccagctggccaagatggttccagtttctgacgcaactcgttctgcagcggcggagatttaaaagtttctctccttagctat

SEQ ID NO: 136 - protein, 420 aa, Corynebacterium glutamicum
MVKRQLPNPAELLELMKFKKPELNGKKRRLDSALTIYDLRKIAKRRTPAAAFDYTDGAAEAELSITRAREAFENIEFHPDILKPAEHVDTTTQILGGTSSMPFGIAPTGFTRLMQTEGEIAGAGAAGAAGIPFTLSTLGTTSIEDVKATNPNGRNWFQLYVMRDREISYGLVERAAKAGFDTLMFTVDTPIAGYRIRDSRNGFSIPPQLTPSTVLNAIPRPWWWIDFLTTPTLEFASLSSTGGTVGDLLNSAMDPTISYEDLKVIREMWPGKLVVKGVQNVEDSVKLLDQGVDGLILSNHGGRQLDRAPVPFHLLPQVRKEVGSEPTIMIDTGIMNGADIVAAVAMGADFTLIGRAYLYGLMAGGREGVDRTIAILRSEITRTMALLGVSSLEELEPRHVTQLAKMVPVSDATRSAAAEI

SEQ ID NO: 137 - DNA, 1836 bp, Corynebacterium glutamicum
  CDS (101)..(1813): RXN01952
ccatcaaaaaatgaacgaccgcggactagctcggatcaaggcgacatcccctcagcatcatgacgcgcttgtgatgcaactgaatataggaagcttagagatgacgcaaccaggacagaccaccacgacttcgcacgaagcgatcgatgcgttcaagagaatcgtcggcgacgaacatgtactgacctctgagcgtgccacgatgccattcagcaaaggctatcgattcggcggaggaccagtcttcgccgtggtgcgccccggcacgctggtcgagatgtggcgggcgctgcaggtatccgtcgacaacaacctcatcgtcatcccgcaggcatcgaacacgggcctgactggtggatccggccccggcttccaagactacgatcgccccattgtgatcatctcgactcaccgcatcgatgaggtgcacctcatcaacgacgcgcgcgaggcgatctcgctcgcgggcaccccgctgacacacctgaccgacgcgctcgccaagcaccagcgcgagccgcactcggtgatcgggtcgacatcaatcggcgcctcggtcatcggcggcatcgcgaacaactcgggcggcagccagattcgcaagggtccggcattcacgcgcgaagcgatcttcgcccgcgtcaacgacgacggcaaggtcgagctggtcaatcacctgggcatctcgctcggagacgaccctgaggtcgcactcgaccgtctacagcgcggcgagtggtctcccgaggatgtcaccccagctcccgaagactcgaacgagaccgagtacgccgagcacttgcgcaagatcgtgccttcgcctgctcgctacaatgcgaaccccgagtacctgttcgaggcttccggctcggccggcaagctgatggtgttcgcggtgcgcacccgcaccttccctcgcgaagtgcacccgaccgtgttttacatcggcacgaacaacacgcacgagctcgaagagatccgtcggttgttcctcgaagccgacatgccgctgcctatctctggtgagtacatgggccgcagtgccttcgacttggccgagaagtacggcaaagacaccttcgtcttcctgaagttcatgagtccagcgctgcagacgcgcatgttctcgttcaagacgtgggccaacggcttgttctcgaagattcccggcattggtccgaccttcgccgacacggtatcgcaagccatgttcagcgtgctgcccaaccagctgcccaagcgcatgatggagtaccgcaaccgtttcgagcatcacctgctgctcaccgtcagcgagtcgcagaaggccgcgagcgagaagatgctcaaggagttcttcgcagagcccgagcacactggtgagttcttcatctgcacgtctgatgaagaaaagagcgcgtcgctcaaccggttcggcgcggccagtgccgccactcgctacgccgcgttgaagcgccggcacatcgcagggctcatccccatcgatgtggccctgcgtcgcgacgattggaactggctcgaggtgctgccggaggagatcgacgaccagcttgaggtcaaggcgtattacgggcacttcttctgccatgtgatgcaccaggactatgtcgccaagcagggcgtggatctcgaggcgctgcacgaccgcatccagcacctgctggaggagcgcggcgcgaagctgcccgccgagcacaactacggtcgcatgtacaagctgccggagtccatggaagagcacttcaaggagctcgatccgacgaatacgttcaacgccggtatcggcggcacgtcgccgcacaaggactgggcctaagtccccaaggtagcgcgacg

SEQ ID NO: 138 - protein, 571 aa, Corynebacterium glutamicum
MTQPGQTTTTSHEAIDAFKRIVGDEHVLTSERATMPFSKGYRFGGGPVFAVVRPGTLVEMWRALQVSVDNNLIVIPQASNTGLTGGSGPGFQDYDRPIVIISTHRIDEVHLINDAREAISLAGTPLTHLTDALAKHQREPHSVIGSTSIGASVIGGIANNSGGSQIRKGPAFTREAIFARVNDDGKVELVNHLGISLGDDPEVALDRLQRGEWSPEDVTPAPEDSNETEYAEHLRKIVPSPARYNANPEYLFEASGSAGKLMVFAVRTRTFPREVHPTVFYIGTNNTHELEEIRRLFLEADMPLPISGEYMGRSAFDLAEKYGKDTFVFLKFMSPALQTRMFSFKTWANGLFSKIPGIGPTFADTVSQAMFSVLPNQLPKRMMEYRNRFEHHLLLTVSESQKAASEKMLKEFFAEPEHTGEFFICTSDEEKSASLNRFGAASAATRYAALKRRHIAGLIPIDVALRRDDWNWLEVLPEEIDDQLEVKAYYGHFFCHVMHQDYVAKQGVDLEALHDRIQHLLEERGAKLPAEHNYGRMYKLPESMEEHFKELDPTNTFNAGIGGTSPHKDWA

SEQ ID NO: 139 - DNA, 239 bp, Corynebacterium glutamicum
  CDS (1)..(216): FRXA01952
ccaggactatgtcgccaagcagggcgtggatctcaaggcgctgacgaccgcatccagcacttgctggaggagcacggcaagaagctgcccgccgagcacaactacggtcgcatgtacaagctgccggagtccatggaagagcacttcaaggagctcgatccgacgaatacgttcaacgccggtatcggcggcacgtcgccgcacaaggactgggcctaagtccccaaggtagcgcgacg

SEQ ID NO: 140 - protein, 72 aa, Corynebacterium glutamicum
PGLCRQAGRGSQGADDRIQHLLEEHGKKLPAEHNYGRMYKLPESMEEHFKELDPTNTFNAGIGGTSPHKDWA

SEQ ID NO: 141 - DNA, 1699 bp, Corynebacterium glutamicum
  CDS (101)..(1699): FRXA01955
ccatcaaaaaatgaacgaccgcggactagctcggatcaaggcgacatcccctcagcatcatgacgcgcttgtgatgcaactgaatataggaagcttagagatgacgcaaccaggacagaccaccacgacttcgcacgaagcgatcgatgcgttcaagagaatcgtcggcgacgaacatgtactgacctctgagcgtgccacgatgccattcagcaaaggctatcgattcggcggaggaccagtcttcgccgtggtgcgccccggcacgctggtcgagatgtggcgggcgctgcaggtatccgtcgacaacaacctcatcgtcatcccgcaggcatcgaacacgggcctgactggtggatccggccccggcttccaagactacgatcgccccattgtgatcatctcgactcaccgcatcgatgaggtgcacctcatcaacgacgcgcgcgaggcgatctcgctcgcgggcaccccgctgacacacctgaccgacgcgctcgccaagcaccagcgcgagccgcactcggtgatcgggtcgacatcaatcggcgcctcggtcatcggcggcatcgcgaacaactcgggcggcagccagattcgcaagggtccggcattcacgcgcgaagcgatcttcgcccgcgtcaacgacgacggcaaggtcgagctggtcaatcacctgggcatctcgctcggagacgaccctgaggtcgcactcgaccgtctacagcgcggcgagtggtctcccgaggatgtcaccccagctcccgaagactcgaacgagaccgagtacgccgagcacttgcgcaagatcgtgccttcgcctgctcgctacaatgcgaaccccgagtacctgttcgaggcttccggctcggccggcaagctgatggtgttcgcggtgcgcacccgcaccttccctcgcgaagtgcacccgaccgtgttttacatcggcacgaacaacacgcacgagctcgaagagatccgtcggttgttcctcgaagccgacatgccgctgcctatctctggtgagtacatgggccgcagtgccttcgacttggccgagaagtacggcaaagacaccttcgtcttcctgaagttcatgagtccagcgctgcagacgcgcatgttctcgttcaagacgtgggccaacggcttgttctcgaagattcccggcattggtccgaccttcgccgacacggtatcgcaagccatgttcagcgtgctgcccaaccagctgcccaagcgcatgatggagtaccgcaaccgtttcgagcatcacctgctgctcaccgtcagcgagtcgcagaaggccgcgagcgagaagatgctcaaggagttcttcgcagagcccgagcacactggtgagttcttcatctgcacgtctgatgaagaaaagagcgcgtcgctcaaccggttcggcgcggccagtgccgccactcgctacgccgcgttgaagcgccggcacatcgcagggctcatccccatcgatgtggccctgcgtcgcgacgattggaactggctcgaggtgctgccggaggagatcgacgaccagcttgaggtcaaggcgtattacgggcacttcttctgccatgtgatgcaccaggactatgtcgccaagcagggcgtggatctcgaggcgctgcacgaccgcatccagcacctgctggaggagcgcggcgcgaagctgcccgccgagcacaac

SEQ ID NO: 142 - protein, 533 aa, Corynebacterium glutamicum
MTQPGQTTTTSHEAIDAFKRIVGDEHVLTSERATMPFSKGYRFGGGPVFAVVRPGTLVEMWRALQVSVDNNLIVIPQASNTGLTGGSGPGFQDYDRPIVIISTHRIDEVHLINDAREAISLAGTPLTHLTDALAKHQREPHSVIGSTSIGASVIGGIANNSGGSQIRKGPAFTREAIFARVNDDGKVELVNHLGISLGDDPEVALDRLQRGEWSPEDVTPAPEDSNETEYAEHLRKIVPSPARYNANPEYLFEASGSAGKLMVFAVRTRTFPREVHPTVFYIGTNNTHELEEIRRLFLEADMPLPISGEYMGRSAFDLAEKYGKDTFVFLKFMSPALQTRMFSFKTWANGLFSKIPGIGPTFADTVSQAMFSVLPNQLPKRMMEYRNRFEHHLLLTVSESQKAASEKMLKEFFAEPEHTGEFFICTSDEEKSASLNRFGAASAATRYAALKRRHIAGLIPIDVALRRDDWNWLEVLPEEIDDQLEVKAYYGHFFCHVMHQDYVAKQGVDLEALHDRIQHLLEERGAKLPAEHN

SEQ ID NO: 143 - DNA, 1035 bp, Corynebacterium glutamicum
  CDS (101)..(1012): RXA00293
agagattgttgattcggcaccaactttacccacgagggtagaaatgaagcattcaggatgacaaaacccaacctcacaccaacaacctatcctggagcccatgaaaatctttgttggttttggcgattatccactcaccaccaaggcccttaaggaggcaggcgcagaaatagtggactccctcgaaaaagccgaggggtttgtcttcactcaaacaccaggcacagaatttcccctacttcccgacggagtgaggtgggtgcaatttcccaatgcggggctcaacgcatatttcacagctgggcagattgatgacaaacgccggtggtcaaatgcatcaggggtgtatggccaacaggtagccgaagcagcaatggctcttttgctgggactgattcatatgcaccccaccatggtgcgtgccgatagttgggcaccaagcactcaaatagatcagcagaccagatggcttgatggtgcaacagttgccattgtgggagctggtggaatcggtaaacatctggcagccatgttgaaaccttttggcgcaaagtctttagcagtaagcaggaccggtacacccacccaagattttgatgcaacggaacctatatccaacctgcaccaagtacttgccgacgccgaccatgtggtgttgtgcgtaccgcttaccgcagacacctatcatctgatcggaaaagcagagcttaaagcaatgcagtccactgcaattttgatcaacgtggctcgcggagaagtagtagatacagaagcattagttgacgccttagatgcccaagaaatatccggggcaggcttagatgtcaccgatcctgaaccattgccggacgatcatccactgtgggggcgcagcaatgtgatcattaccccgcacgtagccaacacgttgacctcgatggatcgcatgcttgccccagtggtggcagaaaactaccgacggtttctcgctggagaaaagatgctgaccgaggtggacatccacaaaggttactagagcagtggctttgaatatag

SEQ ID NO: 144 - protein, 304 aa, Corynebacterium glutamicum
MKIFVGFGDYPLTTKALKEAGAEIVDSLEKAEGFVFTQTPGTEFPLLPDGVRWVQFPNAGLNAYFTAGQIDDKRRWSNASGVYGQQVAEAAMALLLGLIHMHPTMVRADSWAPSTQIDQQTRWLDGATVAIVGAGGIGKHLAAMLKPFGAKSLAVSRTGTPTQDFDATEPISNLHQVLADADHVVLCVPLTADTYHLIGKAELKAMQSTAILINVARGEVVDTEALVDALDAQEISGAGLDVTDPEPLPDDHPLWGRSNVIITPHVANTLTSMDRMLAPVVAENYRRFLAGEKMLTEVDIHKGY

SEQ ID NO: 145 - DNA, 687 bp, Corynebacterium glutamicum
  CDS (62)..(664): RXN01130
agttcgtggcggatgctgtgaacgtttccggtggtcgcgtgggcgaagaggttctgtgtggatggatctggctcgcaagcttggtcttcttgctggcaagcttgtcgacgccgccccagtctccattgaggttgaggctcgaggcgagctttcttccgagcaggtcaatgcacttggtttgtccgctgttcgtggtttgttctccggaattatcgaagagtccgttactttcgtcaacgctcctcgcattgctgaagagcgtggcctggacatctccgtgaagaccaactctgagtctgttactcaccgttccgtcctgcaggtcaaggtcattactggcagcggcgcgagcgcaactgttgttggtgccctgactggtcttgagcgcgttgagaagatcacccgcatcaatggccgtggcctggatctgcgcgcagagggtctgaacctcttcctgcagtacactgacgctcctggtgcactgggtaccgttggtaccaagctgggtgctgctggcatcaacatcgaggctgctgcgttgactcaggctgagaagggtgacggcgctgtcctgatcctgcgtgttgagtccgctgtctctgaagagctggaagctgaaatcaacgctgagttgggtgctacttccttccaggttgatcttgactaattagagatccatttgcttga

SEQ ID NO: 146 - protein, 201 aa, Corynebacterium glutamicum
MDLARKLGLLAGKLVDAAPVSIEVEARGELSSEQVNALGLSAVRGLFSGIIEESVTFVNAPRIAEERGLDISVKTNSESVTHRSVLQVKVITGSGASATVVGALTGLERVEKITRINGRGLDLRAEGLNLFLQYTDAPGALGTVGTKLGAAGINIEAAALTQAEKGDGAVLILRVESAVSEELEAEINAELGATSFQVDLD

SEQ ID NO: 147 - DNA, 326 bp, Corynebacterium glutamicum
  CDS (1)..(303): FRXA01130
gttggtgccctgactggtcttgagcgcgttgagaagatcacccgcatcaatggccgtggcctggatctgcgcgcagagggtctgaacctcttcctgcagtacactgacgctcctggtgcactgggtaccgttggtaccaagctgggtgctgctggcatcaacatcgaggctgctgcgttgactcaggctgagaagggtgacggcgctgtcctgatcctgcgtgttgagtccgctgtctctgaagagctggaagctgaaatcaacgctgagttgggtgctacttccttccaggttgatcttgactaattagagatccatttgcttga

SEQ ID NO: 148 - protein, 101 aa, Corynebacterium glutamicum
VGALTGLERVEKITRINGRGLDLRAEGLNLFLQYTDAPGALGTVGTKLGAAGINIEAAALTQAEKGDGAVLILRVESAVSEELEAEINAELGATSFQVDLD

SEQ ID NO: 149 - DNA, 604 bp, Corynebacterium glutamicum
  CDS (101)..(604): RXN03112
gtgagcacgcaatttctttgctgctgtctactgctcgccagatcctgctgctgatgcgacgctgcgtgagggcgagtggaagcggtcttctttcaacggtgtggaaattttcggaaaaactgtcggtatcgtcggttttggccacattggtcagttgtttgctcagcgtcttgctgcgtttgagaccaccattgttgcttacgatccttacgctaaccctgctcgtgcggctcagctgaacgttgagttggttgagttggatgagctgatgagccgttctgactttgtcaccattcaccttcctaagaccaaggaaactgctggcatgtttgatgcgcacctccttgctaagtccaagaagggccagatcatcatcaacgctgctcgtggtggccttgttgatgagcaggctttggctgatgcgattgagtccggtcacattcgtggcgctggtttcgatgtgtactccaccgagccttgcactgattctcctttgttcaagttgcctcaggttgttgtgactcctcacttgggtgcttctactgaagaggctcaagatcgtgcgggtactgacattgctgattctgtgctcaaggcgctggct

SEQ ID NO: 150 - protein, 168 aa, Corynebacterium glutamicum
VEIFGKTVGIVGFGHIGQLFAQRLAAFETTIVAYDPYANPARAAQLNVELVELDELMSRSDFVTIHLPKTKETAGMFDAHLLAKSKKGQIIINAARGGLVDEQALADAIESGHIRGAGFDVYSTEPCTDSPLFKLPQVVVTPHLGASTEEAQDRAGTDIADSVLKALA

SEQ ID NO: 151 - DNA, 649 bp, Corynebacterium glutamicum
  CDS (101)..(649): FRXA01133
tgtttctagtcgcacgccaaaacccggcgtggacacgtctgcagccgacgcggtcgtgcctgttgtagacggacattcctagtttttccaggagtaacttgtgagccagaatggccgtccggtagtcctcatcgccgataagcttgcgcagtccactgttgacgcgcttggagatgcagtagaagtccgttgggttgacggacctaaccgcccagaactgcttgatgcagttaaggaagcggacgcactgctcgtgcgttctgctaccactgtcgatgctgaagtcatcgccgctgcccctaacttgaagatcgtcggtcgtgccggcgtgggcttggacaacgttgacatccctgctgccactgaagctggcgtcatggttgctaacgcaccgacctctaatattcactccgcttgtgagcacgcaatttctttgctgctgtctactgctcgccagatcctgctgctgatgcgacgctgcgtgagggcgagtggaagcggtcttctttcaacggtgtggaaattttcggaaaaactgtcggtatcgtcggttttggccacattggtcagttgtttgctcagcgtcttgctgcgtttgagaccaccattgttgcttacgatccttacgctaaccctgcttcgtgcgggt

SEQ ID NO: 152 - protein, 183 aa, Corynebacterium glutamicum
VSQNGRPVVLIADKLAQSTVDALGDAVEVRWVDGPNRPELLDAVKEADALLVRSATTVDAEVIAAAPNLKIVGRAGVGLDNVDIPAATEAGVMVANAPTSNIHSACEHAISLLLSTARQILLLMRRCVRASGSGLLSTVWKFSEKLSVSSVLATLVSCLLSVLLRLRPPLLLTILTLTLLRAG

SEQ ID NO: 153 - DNA, 1011 bp, Corynebacterium glutamicum
  CDS (101)..(988): RXN00871
gggaaaaggcgatcaccagccgttggctcgacccagcaacccacggtggcattaacctcggtttcccacagaacgattaattgaaggagagcacaggactatgcgttggttccataagaagggcgaactggcccgagatggttggcaaagcgttgtcgatgccaccaccccaggttgggaatataccggcatccgcattgccgaactgggcagtggtgaatcgcttgaactgaatgacactggtgtggaacgcatcttcattccacttcagggcagcttcgatgttgcccaccatggtcaggtgacccatcttcacggaagaaagtcagtctttgatggaccaaccgatgtgctctacctccccactggacaaacagcaacgctcagtggtcagggacgagtcgccgtggcggaagctcccactcaggaacccaaggagtggaagtacatcgctccagcagaaactcctgtggagttgcgtggagctggccgctcgagccgacaagtccacaactttggcaccccggaagctctcgatgctgctcgactaatcgtgtgtgaagtaatcaccccaggtgaaaactggagctcttaccctccacacaagcatgatgagcacatcccaggacacgagtccaagctggaggaaatctactacttcgaaagcgccccatcgcgagttggtggcagggccgaagcagcagaaggagctttcggaatgttttccacctactcctcaccagcgggggagatcgatatcaacgccatggtgtacagcggcgatatcgcgctagttcctttcggataccacggccctgccgtggcagcacctggctatgacttgtactacctcaacgtcatggcaggacctgatccggagagaatctggctgattaacgatgacccagcgcacgcctgggttcgagatacatggaccgggcaagcatttgatgatcgcttgccatatgagaacgcaaacaaggagggataaaatttcatggctgaaacgaa

SEQ ID NO: 154 - protein, 296 aa, Corynebacterium glutamicum
MRWFHKKGELARDGWQSVVDATTPGWEYTGIRIAELGSGESLELNDTGVERIFIPLQGSFDVAHHGQVTHLHGRKSVFDGPTDVLYLPTGQTATLSGQGRVAVAEAPTQEPKEWKYIAPAETPVELRGAGRSSRQVHNFGTPEALDAARLIVCEVITPGENWSSYPPHKHDEHIPGHESKLEEIYYFESAPSRVGGRAEAAEGAFGMFSTYSSPAGEIDINAMVYSGDIALVPFGYHGPAVAAPGYDLYYLNVMAGPDPERIWLINDDPAHAWVRDTWTGQAFDDRLPYENANKEG

SEQ ID NO: 155 - DNA, 964 bp, Corynebacterium glutamicum
  CDS (101)..(964): FRXA00871
gggaaaaggcgatcaccagccgttggctcgacccagcaacccacggtggcattaacctcggtttcccacagaacgattaattgaaggagagcacaggactatgcgttggttccataagaagggcgaactggcccgagatggttggcaaagcgttgtcgatgccaccaccccaggttgggaatataccggcatccgcattgccgaactgggcagtggtgaatcgcttgaactgaatgacactggtgtggaacgcatcttcattccacttcagggcagcttcgatgttgcccaccatggtcaggtgacccatcttcacggaagaaagtcagtctttgatggaccaaccgatgtgctctacctccccactggacaaacagcaacgctcagtggtcagggacgagtcgccgtggcggaagctcccactcaggaacccaaggagtggaagtacatcgctccagcagaaactcctgtggagttgcgtggagctggccgctcgagccgacaagtccacaactttggcaccccggaagctctcgatgctgctcgactaatcgtgtgtgaagtaatcaccccaggtgaaaactggagctcttaccctccacacaagcatgatgagcacatcccaggacacgagtccaagctggaggaaatctactacttcgaaagcgccccatcgcgagttggtggcagggccgaagcagcagaaggagctttcggaatgttttccacctactcctcaccagcgggggagatcgatatcaacgccatggtgtacagcggcgatatcgcgctagttcctttcggataccacggccctgccgtggcagcacctggctatgacttgtactacctcaacgtcatggcaggacctgatccggagagaatctggctgattaacgatgacccagcgcacgcctgggttcgagatacatggaccgggcaagcatttgatgatcgcttgcca

SEQ ID NO: 156 - protein, 288 aa, Corynebacterium glutamicum
MRWFHKKGELARDGWQSVVDATTPGWEYTGIRIAELGSGESLELNDTGVERIFIPLQGSFDVAHHGQVTHLHGRKSVFDGPTDVLYLPTGQTATLSGQGRVAVAEAPTQEPKEWKYIAPAETPVELRGAGRSSRQVHNFGTPEALDAARLIVCEVITPGENWSSYPPHKHDEHIPGHESKLEEIYYFESAPSRVGGRAEAAEGAFGMFSTYSSPAGEIDINAMVYSGDIALVPFGYHGPAVAAPGYDLYYLNVMAGPDPERIWLINDDPAHAWVRDTWTGQAFDDRLP

SEQ ID NO: 157 - DNA, 373 bp, Corynebacterium glutamicum
  CDS (101)..(373): RXN02829
tttttcgtttaatctcatatttaaacacgttccttttaattggttttataaattgataaactgaattcgtcagttaaagtgtatcgaaaggagactggacatgcaaaaaaatattctaaaaagtggcatcgaaatttctgaacttgggttaggttgcatgagtttaggcacagattataaaaaagcgcaaccaattattgaaagtgcaattgataatggtattacgtattttgatactgcagatatttacgatcaaggagttaatgaagaaattgttggtaaagccttaaaaaaatatcaaaatcgtgatgacatcgttatcggaactaaagttggaaatcgattaactgacgatggacatatgacgtgggat

SEQ ID NO: 158 - protein, 91 aa, Corynebacterium glutamicum
MQKNILKSGIEISELGLGCMSLGTDYKKAQPIIESAIDNGITYFDTADIYDQGVNEEIVGKALKKYQNRDDIVIGTKVGNRLTDDGHMTWD

SEQ ID NO: 159 - DNA, 376 bp, Corynebacterium glutamicum
  CDS (101)..(376): FRXA02829
tttttcgtttaatctcatatttaaacacgttccttttaattggttttataaattgataaactgaattcgtcagttaaagtgtatcgaaaggagactggacatgcaaaaaaatattctaaaaagtggcatcgaaatttctgaacttgggttaggttgcatgagtttaggcacagattataaaaaagcgcaaccaattattgaaagtgcaattgataatggtattacgtattttgatactgcagatatttacgatcaaggagttaatgaagaaattgttggtaaagccttaaaaaaatatcaaaatcgtgatgacatcgttatcggaactaaagttggaaatcgattaactgacgatggacatatgacgtggggatcc

SEQ ID NO: 160 - protein, 92 aa, Corynebacterium glutamicum
MQKNILKSGIEISELGLGCMSLGTDYKKAQPIIESAIDNGITYFDTADIYDQGVNEEIVGKALKKYQNRDDIVIGTKVGNRLTDDGHMTWGS

SEQ ID NO: 161 - DNA, 948 bp, Corynebacterium glutamicum
  CDS (101)..(925): RXN01468
tgccaaggatttgaccaccgtgcaggatttgattgactttattaacaccaataaggctgattagcgggaaaatttcgcccaaaacagggacaatggtgttatgacagtgaacatttcatatctgaccgacatggacggcgtcctcatcaaagagggcgagataattccgggtgcagatcgttttcttcagtctctcaccgataacaatgtggagtttatggttttgaccaacaactccattttcaccccgagggatctttctgcacgtcttaagacttccggtttggatatcccgccggagcgtatttggacttctgcaaccgccactgctcacttcctgaaatcccaggtcaaggagggcacagcctatgttgttggcgagtccggtctgaccactgcgttgcataccgcgggttggattttgacggatgcaaatcctgagtttgttgtcctgggcgaaacccgcacatattccttcgaggcaatcactactgcgataaatctgattttgggtggcgctcgctttatttgcaccaacccggatgtcactggaccttcaccaagtggcattttgcctgctactggctctgtcgccgcacttattaccgcagctactggcgctgagccttattacatcggcaagccaaaccctgtgatgatgcgcagtgcgctgaacaccatcggggcgcattccgagcacactgtcatgatcggcgaccgcatggacaccgacgtgaaatctggtttggaagccggcctgagcaccgtgctggttcgaagcggaatttccgacgacgccgagatccgccgctaccccttccgcccaactcacgtgatcaattccatcgccgatcttgccgattgctgggacgatcctttcggtgacggtgcatttcacgtaccagatgagcagcagttcactgactagtattctgtaggtcatggcat

SEQ ID NO: 162 - protein, 275 aa, Corynebacterium glutamicum
MTVNISYLTDMDGVLIKEGEIIPGADRFLQSLTDNNVEFMVLTNNSIFTPRDLSARLKTSGLDIPPERIWTSATATAHFLKSQVKEGTAYVVGESGLTTALHTAGWILTDANPEFVVLGETRTYSFEAITTAINLILGGARFICTNPDVTGPSPSGILPATGSVAALITAATGAEPYYIGKPNPVMMRSALNTIGAHSEHTVMIGDRMDTDVKSGLEAGLSTVLVRSGISDDAEIRRYPFRPTHVINSIADLADCWDDPFGDGAFHVPDEQQFTD

SEQ ID NO: 163 - DNA, 948 bp, Corynebacterium glutamicum; identical to SEQ ID NO: 161
  CDS (101)..(925): FRXA01468

SEQ ID NO: 164 - protein, 275 aa, Corynebacterium glutamicum; identical to SEQ ID NO: 162

SEQ ID NO: 165 - DNA, 1128 bp, Corynebacterium glutamicum
  CDS (101)..(1105): RXA00794
gcgggttgatacagcccaagcgccgatacatttataatgcgcctagatacgtgcaacccacgtaaccaggtcagatcaagtgccccaggaggcccttcagatgaacctaaagaaccccgaaacgccagaccgtaaccttgctatggagctggtgcgagttacggaagcagctgcactggcttctggacgttgggttggacgtggcatgaagaatgaaggcgacggtgccgctgttgacgccatgcgccagctcatcaactcagtgaccatgaagggcgtcgttgttatcggcgagggcgaaaaagacgaagctccaatgctgtacaacggcgaagaggtcggaaccggctttggacctgaggttgatatcgcagttgacccagttgacggcaccaccctgatggctgagggtcgccccaacgcaatttccattctcgcagctgcagagcgtggcaccatgtacgatccatcctccgtcttctacatgaagaagatcgccgtgggacctgaggccgcaggcaagatcgacatcgaagctccagttgcccacaacatcaacgcggtggcaaagtccaagggaatcaacccttccgacgtcaccgttgtcgtgcttgaccgtcctcgccacatcgaactgatcgcagacattcgtcgtgcaggcgcaaaggttcgtctcatctccgacggcgacgttgcaggtgcagttgcagcagctcaggattccaactccgtggacatcatgatgggcaccggcggaaccccagaaggcatcatcactgcgtgcgccatgaagtgcatgggtggcgaaatccagggcatcctggccccaatgaacgatttcgagcgccagaaggcacacgacgctggtctggttcttgatcaggttctgcacaccaacgatctggtgagctccgacaactgctacttcgtggcaaccggtgtgaccaacggtgacatgctccgtggcgtttcctaccgcgcaaacggcgcaaccacccgttccctggttatgcgcgcaaagtcaggcaccatccgccacatcgagtctgtccaccagctgtccaagctgcaggaatactccgtggttgactacaccaccgcgacctaagagctcttagttcgaaaaac

SEQ ID NO: 166 - protein, 335 aa, Corynebacterium glutamicum
MNLKNPETPDRNLAMELVRVTEAAALASGRWVGRGMKNEGDGAAVDAMRQLINSVTMKGVVVIGEGEKDEAPMLYNGEEVGTGFGPEVDIAVDPVDGTTLMAEGRPNAISILAAAERGTMYDPSSVFYMKKIAVGPEAAGKIDIEAPVAHNINAVAKSKGINPSDVTVVVLDRPRHIELIADIRRAGAKVRLISDGDVAGAVAAAQDSNSVDIMMGTGGTPEGIITACAMKCMGGEIQGILAPMNDFERQKAHDAGLVLDQVLHTNDLVSSDNCYFVATGVTNGDMLRGVSYRANGATTRSLVMRAKSGTIRHIESVHQLSKLQEYSVVDYTTAT

SEQ ID NO: 167 - DNA, 1035 bp, Corynebacterium glutamicum
  CDS (101)..(1012): RXN02920
tgcatgcagattatctgtccaactacgccagccgcgcgtaaagcgcgggcctgctggtggcgggtggcgtcgaaaagcatttttaaaggagtttaagacgatgaagtttgttatgtatccgcatttgtgggagtccacgaccgctgtcattgagggtggcggacatgagcgggttgaggatattaaagatgcagacttcattttctttaatggttcagcgccggagttcccggatttgccggagaacatcaagttcgtgcaggcctccatggcgggtattgatgcgctggtcaagcgtggtgtcgtcaatgagaaggcacgttgggcaaacgcggctggcctgtacgctgacaccgttgctgagtccaccattggtttaattctggcgcagatgcacatgcatgcgacgactcgtttggctaagtcgtggagcgtgcggcctgaggtggaaaacaacaagtcatggctgcatgacaataaaactgtcgctattttgggcgccggtggcattggcgtgcgtctgctggaaatgctcaagccgttcaacgtgaagaccattgcggttaataactctggtcgtccggtggaaggtgcagatgaaaccttcgccatggataaggctgagcacgtgtgggctgaggctgatgtgtttgtgctcatcctgccgctgactgatgccacttatcagatcgtcaatgcagaaactttgggcaagatgaagccttctgccgtggtggtcaatgtggggcgtggcccgctgatcaacaccgatgatctggtggatgcattgaacaacggcaccattgcgggtgctgcgctggacgttaccgatcctgagccacttcctgacagccacccgctgtgggagatggacaatgtggttatcactcctcatactgcaaacacgaatgagaggattcgtgctttgaccggcgaactcaccttgcgcaacattgagttgtttgaggcaggcgagcagatggccaccgaggtcgatgtggtggctggctactaggccttttatggtgtgatccg

SEQ ID NO: 168 - protein, 304 aa, Corynebacterium glutamicum
MKFVMYPHLWESTTAVIEGGGHERVEDIKDADFIFFNGSAPEFPDLPENIKFVQASMAGIDALVKRGVVNEKARWANAAGLYADTVAESTIGLILAQMHMHATTRLAKSWSVRPEVENNKSWLHDNKTVAILGAGGIGVRLLEMLKPFNVKTIAVNNSGRPVEGADETFAMDKAEHVWAEADVFVLILPLTDATYQIVNAETLGKMKPSAVVVNVGRGPLINTDDLVDALNNGTIAGAALDVTDPEPLPDSHPLWEMDNVVITPHTANTNERIRALTGELTLRNIELFEAGEQMATEVDVVAGY

SEQ ID NO: 169 - DNA, 779 bp, Corynebacterium glutamicum
  CDS (52)..(756): FRXA02379
tgcaggcctccatggcgggtattgatgcgctggtcaagcgtggtgtcgtcaatgagaaagcaccgttgggcaaacgcggctggcctgtacgctgacaccgttgctgagtccaccattggtttaattctggcgcagatgcacatgcatgcgacgactcgtttggctaagtcgtggagcgtgcggcctgaggtggaaaacaacaagtcatggctgcatgacaataaaactgtcgctattttgggcgccggtggcattggcgtgcgtctgctggaaatgctcaagccgttcaacgtgaagaccattgcggttaataactctggtcgtccggtggaaggtgcagatgaaaccttcgccatggataaggctgagcacgtgtgggctgaggctgatgtgtttgtgctcatcctgccgctgactgatgccacttatcagatcgtcaatgcagaaactttgggcaagatgaagccttctgccgtggtggtcaatgtggggcgtggcccgctgatcaacaccgatgatctggtggatgcattgaacaacggcaccattgcgggtgctgcgctggacgttaccgatcctgagccacttcctgacagccacccgctgtgggagatggacaatgtggttatcactcctcatactgcaaacacgaatgagaggattcgtgctttgaccggcgaactcaccttgcgcaacattgagttgtttgaggcaggcgagcagatggccaccgaggtcgatgtggtggctggctactaggccttttatggtgtgatccg

SEQ ID NO: 170 - protein, 235 aa, Corynebacterium glutamicum
MRKHRWANAAGLYADTVAESTIGLILAQMHMHATTRLAKSWSVRPEVENNKSWLHDNKTVAILGAGGIGVRLLEMLKPFNVKTIAVNNSGRPVEGADETFAMDKAEHVWAEADVFVLILPLTDATYQIVNAETLGKMKPSAVVVNVGRGPLINTDDLVDALNNGTIAGAALDVTDPEPLPDSHPLWEMDNVVITPHTANTNERIRALTGELTLRNIELFEAGEQMATEVDVVAGY

SEQ ID NO: 171 - DNA, 792 bp, Corynebacterium glutamicum
  CDS (101)..(769): RXN02688
gtgcggaagacagcacgccccaaaccgaccaactagctaagctacacaaggcggacgaatgggttcgcgcagcaagcgaaggaaggaaacttaactagccatggccggccggattattttgctacgacacgggcagactcacaacaacgtcaaacacctcctggacacccgcccaccaggagctgaactcaccgacctgggccgtaaacaagcccttgaagttggccacgaactagccacctactccggtgagcgcctcgcccatgtgtacagctccatcgtgttgcgcgcccaacaaaccgccgtgcttgccacctctacctttgaaaaagctcgcgacatgcagtccggtgcgattccactcgacgttgtggaaggcattcaggaaatcaacgtcggcgactttgaaatgcgcggcgatgaagaagcccacatgaattactcccgcgcactcaacggctggcttcacggggatcctgccgctggtcttcccggcggtgagacctacaaagacgtgctgaaccgctaccagccgactcttgatcgaatcatggacagccacgaccttgacgacgaccgcgacgttgccgttgtcagccacggcgccgtcatccgcatcgtggcaacacacgcaactggtgtggatcccaactttgcgttcaacacctacctgggcaactgccgcttcgtggtgctggagccaaacggtaagaaattcagccaatgggatgttgtgcgctggactgacagcccactgccatggcaggagtaattgagaccaaaggctcggat

SEQ ID NO: 172 - protein, 223 aa, Corynebacterium glutamicum
MAGRIILLRHGQTHNNVKHLLDTRPPGAELTDLGRKQALEVGHELATYSGERLAHVYSSIVLRAQQTAVLATSTFEKARDMQSGAIPLDVVEGIQEINVGDFEMRGDEEAHMNYSRALNGWLHGDPAAGLPGGETYKDVLNRYQPTLDRIMDSHDLDDDRDVAVVSHGAVIRIVATHATGVDPNFAFNTYLGNCRFVVLEPNGKKFSQWDVVRWTDSPLPWQE

SEQ ID NO: 173 - DNA, 336 bp, Corynebacterium glutamicum
  CDS (101)..(313): RXN03087
gttgccgccagccgttccagggcgcttgagctggtcagcgacatcgcaatgatcaaccaggaatacctggaaaagagctgatattgatagggtttaagtcatgaagatctacgcaccttttgctggaatcgtccactattttgtcgatgaaggcgatcccgtggaaaccggcatgcaactgggaacggtagaaaccatcaaactcgaggcaccaatcatggcaccgggacctggcatcgtagctaaggtttcttttgatgatttctccgacgtcaccggcggcgatgaactcctcgaattggaggcaaagaactaatgggtcaaacccgcatcatt

SEQ ID NO: 174 - protein, 71 aa, Corynebacterium glutamicum
MKIYAPFAGIVHYFVDEGDPVETGMQLGTVETIKLEAPIMAPGPGIVAKVSFDDFSDVTGGDELLELEAKN

SEQ ID NO: 175 - DNA, 310 bp, Corynebacterium glutamicum
  CDS (101)..(310): RXN03186
ttcgtgcacttcggcgtgtcacaattaggtacgaccaagaatgggaccgggaaaccgggacgtataaacgaaataaaacattccaacaggaggtgtggaaatggccgatcaagcaaaacttggtggcaagccctcggatgactctaacttcgcgatgatccgcgatggcgtggcatcttatttgaacgactcagatccggaggagaccaacgagtggatggattcactcgacggattactccaggagtcttctccagaacgtgctcgttacctcatgcttcgtttgcttgagcgtgcatctgcaaagcgc

SEQ ID NO: 176 - protein, 70 aa, Corynebacterium glutamicum
MADQAKLGGKPSDDSNFAMIRDGVASYLNDSDPEETNEWMDSLDGLLQESSPERARYLMLRLLERASAKR

SEQ ID NO: 177 - DNA, 302 bp, Corynebacterium glutamicum; identical to SEQ ID NO: 93
  CDS (1)..(279): RXN03187

SEQ ID NO: 178 - protein, 93 aa, Corynebacterium glutamicum; identical to SEQ ID NO: 94

SEQ ID NO: 179 - DNA, 1953 bp, Corynebacterium glutamicum
  CDS (101)..(1930): RXN02591
atgtgtccgttgtctcacctaaagttttaactagttctgtatctgaaagctacgctagggggcgagaactctgtcgaatgacacaaaatctggagaagtaatgactactgctgcaatcaggggccttcagggcgaggcgccgaccaagaataaggaactgctgaactggatcgcagacgccgtcgagctcttccagcctgaggctgttgtgttcgttgatggatcccaggctgagtgggatcgcatggcggaggatcttgttgaagccggtaccctcatcaagctcaacgaggaaaagcgtccgaacagctacctagctcgttccaacccatctgacgttgcgcgcgttgagtcccgcaccttcatctgctccgagaaggaagaagatgctggcccaaccaacaactgggctccaccacaggcaatgaaggacgaaatgtccaagcattacgctggttccatgaaggggcgcaccatgtacgtcgtgcctttctgcatgggtccaatcagcgatccggaccctaagcttggtgtgcagctcactgactccgagtacgttgtcatgtccatgcgcatcatgacccgcatgggtattgaagcgctggacaagatcggcgcgaacggcagcttcgtcaggtgcctccactccgttggtgctcctttggagccaggccaggaagacgttgcatggccttgcaacgacaccaagtacatcacccagttcccagagaccaaggaaatttggtcctacggttccggctacggcggaaacgcaatcctggcaaagaagtgctacgcactgcgtatcgcatctgtcatggctcgcgaagaaggatggatggctgagcacatgctcatcctgaagctgatcaacccagagggcaaggcgtaccacatcgcagcagcattcccatctgcttgtggcaagaccaacctcgccatgatcactccaaccatcccaggctggaccgctcaggttgttggcgacgacatcgcttggctgaagctgcgcgaggacggcctctacgcagttaacccagaaaatggtttcttcggtgttgctccaggcaccaactacgcatccaacccaatcgcgatgaagaccatggaaccaggcaacaccctgttcaccaacgtggcactcaccgacgacggcgacatctggtgggaaggcatggacggcgacgccccagctcacctcattgactggatgggcaacgactggaccccagagtccgacgaaaacgctgctcaccctaactcccgttactgcgtagcaatcgaccagtccccagcagcagcacctgagttcaacgactgggaaggcgtcaagatcgacgcaatcctcttcggtggacgtcgcgcagacaccgtcccactggttacccagacctacgactgggagcacggcaccatggttggtgcactgctcgcatccggtcagaccgcagcttccgcagaagcaaaggtcggcacactccgccacgacccaatggcaatgctcccattcattggctacaacgctggtgaatacctgcagaactggattgacatgggtaacaagggtggcgacaagatgccatccatcttcctggtcaactggttccgccgtggcgaagatggacgcttcctgtggcctggcttcggcgacaactctcgcgttctgaagtgggtcatcgaccgcatcgaaggccacgttggcgcagacgagaccgttgttggacacaccgctaaggccgaagacctcgacctcgacggcctcgacaccccaattgaggatgtcaaggaagcactgaccgctcctgcagagcagtgggcaaacgacgttgaagacaacgccgagtacctcactttcctcggaccacgtgttcctgcagaggttcacagccagttcgatgctctgaaggcccgcatttcagcagctcacgcttaaagttcacgcttaagaactgc

SEQ ID NO: 180 - protein, 610 aa, Corynebacterium glutamicum
MTTAAIRGLQGEAPTKNKELLNWIADAVELFQPEAVVFVDGSQAEWDRMAEDLVEAGTLIKLNEEKRPNSYLARSNPSDVARVESRTFICSEKEEDAGPTNNWAPPQAMKDEMSKHYAGSMKGRTMYVVPFCMGPISDPDPKLGVQLTDSEYVVMSMRIMTRMGIEALDKIGANGSFVRCLHSVGAPLEPGQEDVAWPCNDTKYITQFPETKEIWSYGSGYGGNAILAKKCYALRIASVMAREEGWMAEHMLILKLINPEGKAYHIAAAFPSACGKTNLAMITPTIPGWTAQVVGDDIAWLKLREDGLYAVNPENGFFGVAPGTNYASNPIAMKTMEPGNTLFTNVALTDDGDIWWEGMDGDAPAHLIDWMGNDWTPESDENAAHPNSRYCVAIDQSPAAAPEFNDWEGVKIDAILFGGRRADTVPLVTQTYDWEHGTMVGALLASGQTAASAEAKVGTLRHDPMAMLPFIGYNAGEYLQNWIDMGNKGGDKMPSIFLVNWFRRGEDGRFLWPGFGDNSRVLKWVIDRIEGHVGADETVVGHTAKAEDLDLDGLDTPIEDVKEALTAPAEQWANDVEDNAEYLTFLGPRVPAEVHSQFDALKARISAAHA

SEQ ID NO: 181 - DNA, 1305 bp, Corynebacterium glutamicum
  CDS (101)..(1282): RXS01260
ctaaacgtgggctgcattccttccaaagtctctgatcaaaaacgctgaagttgcccatacctttacccatgagaagaagaccttcggcatcaatggcgaagtgaccttcaactatgaggatgctcacaagcgttcccgtggcgtttccgacaagatcgttggaggcgttcattacttgatgaagaagaacaagatcatcgaaattcatggtcttggaaacttcaaggatgctaagactcttgaggtcaccgacggtaaggatgctggcaagaccatcacctttgatgactgcatcatcgcaaccggttcggtagtcaacaccctccgtggcgttgacttctcagagaacgttgtgtcttttgaagagcagattcttaaccctgttgcgccaaagaagatggtcattgttggtgcaggcgcaattggaatggaattcgcctacgttcttggtaactacggtgtagatgtaaccgtcatcgagttcatggatcgtgtgcttccaaatgaagatgctgaagtctccaaggttattgcaaaggcctacaagaagatgggcgttaagcttcttcctggccatgcaaccactgctgttcgggacaacggtgactttgtcgaggttgattaccagaagaagggctctgacaagacagagactcttactgttgatcgagtcatggtttccgttggtttccgtccacgcgttgagggatttggtcttgaaaacactggcgttaagctcaccgagcgtggcgcaatcgagatcgatgattacatgcgtaccaacgtcgatggcatttacgccatcggtgacgtgaccgccaagcttcagcttgctcacgtcgcagaagcacagggcattgttgccgcagagactattgctggtgcagaaactcagactcttggtgattacatgatgatgccacgtgcaaccttctgcaacccacaggtttcttcctttggttacaccgaagagcaggccaaggagaagtggccagatcgtgagatcaaggttgcttccttcccattctctgcaaacggtaaagcagttggcctggcagaaactgatggtttcgcaaagatcgttgctgatgcagaattcggtgagctgctcggtgcacacctggttggagcaaatgcatcagagctcatcaatgaattggtgcttgctcagaactgggatctcaccactgaagagatctctcgtagcgtccatattcacccaacgctatctgaggcagttaaggaagctgcacacggtatctctggacacatgatcaacttctagaatccacctcgttggccctg

SEQ ID NO: 182 - protein, 394 aa, Corynebacterium glutamicum
VTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASFPFSANGKAVGLAETDGFAKIVADAEFGELLGAHLVGANASELINELVLAQNWDLTTEEISRSVHIHPTLSEAVKEAAHGISGHMINF

SEQ ID NO: 183 - DNA, 294 bp, Corynebacterium glutamicum
  CDS (101)..(271): RXS01261
gtgggtgtttttcattttcttccactctaaaattaagtatggaaaaccaaccgcacccggatgcacgacaatgacccactaaacacgtatccttgaatgcgtgactgaacattatgacgtagtagtactcggagccggccccggtggctatgtctccgccatccgtgcagcgcagcttggcaagaaggttgctgtaattgagaagcagtactggggtggtgtttgcctaaacgtgggctgcattccttccaaagtctctgatcaaaaacgctgaagttgcccatacctttaccc

SEQ ID NO: 184 - protein, 57 aa, Corynebacterium glutamicum
VTEHYDVVVLGAGPGGYVSAIRAAQLGKKVAVIEKQYWGGVCLNVGCIPSKVSDQKR

SEQ ID NO: 185 - DNA, 1650 bp, Corynebacterium glutamicum
  CDS (101)..(1627): RXA02640
accaacgacgacgccggtgtagcagatgtattggagtggtggttctaataggtggtgttaaaacactgcttagtggcccaatacgtgcaaaaataaggccatgagaatctcaaaggccaatgcgtatgttgcagcgattgaccaaggcaccacttccactcggtgcatcttcattgatgcccaaggaaaagtggtgtcttctgcttccaaggagcaccgccaaatcttcccacaacagggctgggtagagcacgatcctgaagaaatttgggacaacattcgatctgtcgtcagccaggcgatggtctccattgacatcaccccacacgaggttgcatcgctgggagtcaccaaccagcgcgaaaccaccgtggtgtgggacaagcacaccggcgaacctgtctacaacgcaatcgtgtggcaagacacccgcacctctgacatttgcctagagatcgcgggcgaagaaggccaggaaaagtggcttgaccgcaccggcctgctgatcaactcctacccatcggggcccaaaatcaagtggattctcgacaacgttgagggagctcgcgaacgcgccgaaaagggcgaccttttgtttggcaccatggatacctgggtgctgtggaacctgaccggcggtgtccgcggcgacgacggtgatgatgccatccacgtcaccgatgtcaccaacgcatcccgcacactattgatggatctccgcacgcaacagtgggatccagaactatgcgaagccctagacattccgatgtccatgctccctgagattcgtccctccgtcggagaattccgctccgtgcgccaccgcggaaccctagccgacgtcccgattactggcgtgctcggcgaccagcaagcggccctttttggtcagggcggattccacgaaggtgctgctaaaaatacctacggcaccggcctcttcctgctgatgaacaccggcacctcgttgaagatttccgagcacggcctgctgtccaccatcgcctatcaacgggaaggatccgctccggtctacgcgctggaaggttccgtatccatgggcggttccttggtgcagtggctgcgcgacaacctacagctaatccccaacgcaccagcgattgaaaacctcgcccgagaagtcgaagacaacggtggcgttcatgttgtcccagcattcaccggactgttcgcaccacgttggcgccccgatgctcgtggcgtcattacaggcctcacccgttttgccaaccgcaaacacatcgcccgcgcagtccttgaagccaacgccttccaaacccgcgaagttgtggacgccatggccaaagacgcaggcaaagccctcgaatccctccgcgtcgacggtgcgatggtggaaaatgacctcctcatgcaaatgcaagccgacttcctcggcatcgacgtccaacgtctcgaggacgtagaaaccaccgccgtcggcgtcgcattcgctgcaggtctcggctctggattcttcaaaacaactgacgagatcgaaaaacttattgcagtgaagaaagtctggaaccctgacatgagcgaagaagagcgcgaacgtcgctatgccgaatggaatagggcagtggagcattcttatgaccaggcctagctgatttgggtcggccttta

SEQ ID NO: 186 - protein, 509 aa, Corynebacterium glutamicum
MRISKANAYVAAIDQGTTSTRCIFIDAQGKVVSSASKEHRQIFPQQGWVEHDPEEIWDNIRSVVSQAMVSIDITPHEVASLGVTNQRETTVVWDKHTGEPVYNAIVWQDTRTSDICLEIAGEEGQEKWLDRTGLLINSYPSGPKIKWILDNVEGARERAEKGDLLFGTMDTWVLWNLTGGVRGDDGDDAIHVTDVTNASRTLLMDLRTQQWDPELCEALDIPMSMLPEIRPSVGEFRSVRHRGTLADVPITGVLGDQQAALFGQGGFHEGAAKNTYGTGLFLLMNTGTSLKISEHGLLSTIAYQREGSAPVYALEGSVSMGGSLVQWLRDNLQLIPNAPAIENLAREVEDNGGVHVVPAFTGLFAPRWRPDARGVITGLTRFANRKHIARAVLEANAFQTREVVDAMAKDAGKALESLRVDGAMVENDLLMQMQADFLGIDVQRLEDVETTAVGVAFAAGLGSGFFKTTDEIEKLIAVKKVWNPDMSEEERERRYAEWNRAVEHSYDQA

SEQ ID NO: 187 - DNA, 1119 bp, Corynebacterium glutamicum
  CDS (101)..(1096): RXN01025
gggcagcagcggcaggtttccaggaggtttccatgcgggtggcttgggacatgggctaacctgagacggttaaatatcgttttcgaaaggtgggtttcgcgtggtttctgtaagcgtgatgggtgcaggttcctggggaaccacgttggccaaggtcttctctgatgctggcaacgctgtgacgttgtgggcgaggcgggaagagttggcaagcaccatccgtgacagccatgaaaaccgtgattaccttccggggattacgttgccggagtcgctgcaggtcacatcatcggcaacggaggctttagagggcgcagccattgtggtgttggcgattccttcgcaggcgttgcgtggcaatttggcggagtggaaagagacgatcccgcaggatgcgaccttggtgtccttggctaaaggtattgaaaagggcacgcacctgcggatgagtgaagtgatcgcggaggtgacggaagcggatccttcacgcatcgcggtgttgtcggggccaaaccttgctcgtgagatcgcggaggggcagcctgcagctacggtgattgcttgccctgatgaaaaccgagcgaaacttgtgcaggctgcagtggctgcgccgtatttccgcccgtacaccaacactgatgtggtgggcactgaaatcggtggtgcgtgtaagaacgtcatcgcgctggcctgtggtatttcccatggttacggcctgggtgagaacaccaatgcatcgttgattactcgtggccttgcagagatcgcacgcctcggtgccacattgggtgcggatgcgaagactttttctggccttgcgggaatgggcgacttggtggctacgtgttcatcaccgctgtcgcgtaaccgcagcttcggtgagcgtttgggtcagggtgaatccctagagaaggctcgcgaggcaaccaatggtcaggttgcggagggtgttatttcctcgcagtcgatttttgatcttgccaccaagcttggtgtggagatgccgatcacccaggctgtctacggtgtgtgccaccgagatatgaaagtaactgacatgattgtggctctcatgggcaggtctaagaaggctgagtagtcttaggttgtaagcttcaa

SEQ ID NO: 188 - protein, 332 aa, Corynebacterium glutamicum
VVSVSVMGAGSWGTTLAKVFSDAGNAVTLWARREELASTIRDSHENRDYLPGITLPESLQVTSSATEALEGAAIVVLAIPSQALRGNLAEWKETIPQDATLVSLAKGIEKGTHLRMSEVIAEVTEADPSRIAVLSGPNLAREIAEGQPAATVIACPDENRAKLVQAAVAAPYFRPYTNTDVVGTEIGGACKNVIALACGISHGYGLGENTNASLITRGLAEIARLGATLGADAKTFSGLAGMGDLVATCSSPLSRNRSFGERLGQGESLEKAREATNGQVAEGVISSQSIFDLATKLGVEMPITQAVYGVCHRDMKVTDMIVALMGRSKKAE

SEQ ID NO: 189 - DNA, 1015 bp, Corynebacterium glutamicum
  CDS (101)..(1015): FRXA01025
gggcagcagcggcaggtttccagraggtttccatgcgggtggcttggracwtgggctaacctgaracggttaaatatcgttttcgaaaggtgggtttcgcgtggtttctgtaagcgtgatgggtgcaggttcctggggaaccacgttggccaaggtcttctctgatgctggcaacgctgtgacgttgtgggcgaggcgggaagagttggcaagcaccatccgtgacagccatgaaaaccgtgattaccttccggggattacgttgccggagtcgctgcaggtcacatcatcggcaacggaggctttagagggcgcagccattgtggtgttggcgattccttcgcaggcgttgcgtggcaatttggcggagtggaaagagacgatcccgcaggatgcgaccttggtgtccttggctaaaggtattgaaaagggcacgcacctgcggatgagtgaagtgatcgcggaggtgacggaagcggatccttcacgcatcgcggtgttgtcggggccaaaccttgctcgtgagatcgcggaggggcagcctgcagctacggtgattgcttgccctgatgaaaaccgagcgaaacttgtgcaggctgcagtggctgcgccgtatttccgcccgtacaccaacactgatgtggtgggcactgaaatcggtggtgcgtgtaagaacgtcatcgcgctggcctgtggtatttcccatggttacggcctgggtgagaacaccaatgcatcgttgattactcgtggccttgcagagatcgcacgcctcggtgccacattgggtgcggatgcgaagactttttctggccttgcgggaatgggcgacttggtggctacgtgttcatcaccgctgtcgcgtaaccgcagcttcggtgagcgtttgggtcagggtgaatccctagagaaggctcgcgaggcaaccaatggtcaggttgcggagggtgttatttcctcgcagtcgatttttgatcttgccaccaagcttggtgtggagatgccgatcacccag

SEQ ID NO: 190 - protein, 305 aa, Corynebacterium glutamicum
VVSVSVMGAGSWGTTLAKVFSDAGNAVTLWARREELASTIRDSHENRDYLPGITLPESLQVTSSATEALEGAAIVVLAIPSQALRGNLAEWKETIPQDATLVSLAKGIEKGTHLRMSEVIAEVTEADPSRIAVLSGPNLAREIAEGQPAATVIACPDENRAKLVQAAVAAPYFRPYTNTDVVGTEIGGACKNVIALACGISHGYGLGENTNASLITRGLAEIARLGATLGADAKTFSGLAGMGDLVATCSSPLSRNRSFGERLGQGESLEKAREATNGQVAEGVISSQSIFDLATKLGVEMPITQ

SEQ ID NO: 191 - DNA, 1809 bp, Corynebacterium glutamicum
  CDS (101)..(1786): RXA01851
ttgtggcctttttgcaggggaaacttatttaaataattcataagtaaaaaaccgtcaattcacgatgtgggttggcggttttcctattaggctcacttttatgacgagcgcacactttgaatcccgccggattggccctccgcttcgcgataattatgacgtcattgtgattggcggtggtatctcaggtgtacagattgcgcgacatgctcaaggccgcggtttacgcactgtgatgtttgaggccagagattattcttctggaacatcatcgacaacctccaagatgattcatggtggtttgcgctatttggagcagtacgatttcggcgtggtccaggaagccgtgaaggaacgccggtacctaggtatcgccgctccgcatttggtggctccacgcagtttcatgctcacggcgtttgattggtcagagccgaaagcccctatgttgggtgctggtgtggcgttgtatgaaacgatggcgtggcagcgtaaccaggggcaatcgaaggaaaaccactcgccgcgtttccggtggattcctaaaaatgcactgctcaaggaagtcccgtggcttgacccggagggcttgaagggagcgtggcgccacgatgatacgttgaatctccatgcagaacgactcctcctcgcggtgattaaagcttttgcggcagatggcggaacggcgatcaaccacgccaaagtcactcgcattctccggaacgtggaagaaggccgcgtcaagggtgtagaagtgactgatcaggtcaccaacaccacgcatgaggtgaatgcccctgtggtgatcaacgctgcgggtccgtgggttgcgcaggcgttgggtgatttggcggaggtaaccaagttgaaggtgcgccaatccaagggagtgcatttgctcactggtgatttgggcagccagagtggcgtgtttgtgcgtggcaaaaacggcaagcatgtgatcgtgaatccgtggatggggcgcacccttattggtccaaccgacaccatgattgacggtgacgctgatgatgcggctgcagatgaaagcgatatcgatttgctgcttgagaccatcgattcggtacgcgctacaccgcttgatcgcaaagagatcatctccacgctggtgggtgtgcgcccgcttgttgatgacggcaccgacacctacacgtcctctcgccgtttcgatatttccgatcacgccaacgtcggcattgatggtttggtgtctgtctctggcggcaagtggaccacttcccgcgtgatggggtacaaggtgattgagcatgtggtggagcaccaagctgcggtgttacctccgctgcgccactttgactccaggcagatgccgttgagtacttcttttggcgcgtatgagtccgtggctgattcctttgagtcagcgcttcgcagccaccccgagctggatgtggatgatgaaatccgcgtgcatctggccagactgtatggaactgagcatgaaaaagtgctggatctcgtcgcaaagcaacccgacctggggcgccgacttgacccagacaaccttgatatcgcggcgcaggccgtttttgctgtcgccgaggaggcggccgtcgacctggcggacgtgctggatcgtcgcatcgtgctcggcacgctgggttatgtgcaaccggctgccgtgcgtgcgacggccgaagcaatggcgcaggtcaccgggtggtcagctgagcttatcgacgcccagtgccagtcctacctcgccaagcaagacaaaatccaagccgtgttaaagccgtaccgctaacactccgtcatcgacaccgg

SEQ ID NO: 192 - protein, 562 aa, Corynebacterium glutamicum
MTSAHFESRRIGPPLRDNYDVIVIGGGISGVQIARHAQGRGLRTVMFEARDYSSGTSSTTSKMIHGGLRYLEQYDFGVVQEAVKERRYLGIAAPHLVAPRSFMLTAFDWSEPKAPMLGAGVALYETMAWQRNQGQSKENHSPRFRWIPKNALLKEVPWLDPEGLKGAWRHDDTLNLHAERLLLAVIKAFAADGGTAINHAKVTRILRNVEEGRVKGVEVTDQVTNTTHEVNAPVVINAAGPWVAQALGDLAEVTKLKVRQSKGVHLLTGDLGSQSGVFVRGKNGKHVIVNPWMGRTLIGPTDTMIDGDADDAAADESDIDLLLETIDSVRATPLDRKEIISTLVGVRPLVDDGTDTYTSSRRFDISDHANVGIDGLVSVSGGKWTTSRVMGYKVIEHVVEHQAAVLPPLRHFDSRQMPLSTSFGAYESVADSFESALRSHPELDVDDEIRVHLARLYGTEHEKVLDLVAKQPDLGRRLDPDNLDIAAQAVFAVAEEAAVDLADVLDRRIVLGTLGYVQPAAVRATAEAMAQVTGWSAELIDAQCQSYLAKQDKIQAVLKPYR

SEQ ID NO: 193 - DNA, 900 bp, Corynebacterium glutamicum
  CDS (101)..(877): RXA01242
cgccggcaaccaaatgaggcttttgggcgttggacagtgagacaatgggtaagaaattcggacatatttagtaaattggctttttgctttaaggagtgacatgtacgcagaggagcgccgtcgacagattgcctcattaacggcagttgagggacgtgtaaatgtcacagaattagcgggccgattcgatgtcactgcagagacgattcgacgagaccttgcggtgctagaccgcgagggaattgttcaccgcgttcacggtggcgcagtagccacccaatctttccaaaccacagagttgagcttggatactcgtttcaggtctgcatcgtcagcaaagtactccattgccaaggcagcgatgcagttcctgcccgctgagcatggcggactgttcctcgatgcgggaactactgttactgctttggccgatctcatttctgagcatcctagctccaagcagtggtcgatcgtgaccaactgcctccccatcgcacttaatctggccaacgccgggcttgatgatgtccagctgcttggaggaagcgttcgcgcgatcacccaggctgttgtgggtgacactgcgcttcgtactctcgcgctgatgcgtgcggatgtagtgttcatcggcaccaacgcgttgacgttggatcacggattgtctacggccgattcccaagaggctgccatgaaatctgcgatgatcaccaacgcccacaaggtggtggtgttgtgtgactccaccaagatgggcaccgactacctcgtgagctttggcgcaatcagcgatatcgatgtggtggtcaccgatgcgggtgcaccagcaagtttcgttgagcagttgcgagaacgcgatgtagaagttgtgattgcagaatgattcttacagtcactgcaagt

SEQ ID NO: 194 - protein, 259 aa, Corynebacterium glutamicum
MYAEERRRQIASLTAVEGRVNVTELAGRFDVTAETIRRDLAVLDREGIVHRVHGGAVATQSFQTTELSLDTRFRSASSAKYSIAKAAMQFLPAEHGGLFLDAGTTVTALADLISEHPSSKQWSIVTNCLPIALNLANAGLDDVQLLGGSVRAITQAVVGDTALRTLALMRADVVFIGTNALTLDHGLSTADSQEAAMKSAMITNAHKVVVLCDSTKMGTDYLVSFGAISDIDVVVTDAGAPASFVEQLRERDVEVVIAE

SEQ ID NO: 195 - DNA, 969 bp, Corynebacterium glutamicum
  CDS (101)..(946): RXA02288
aacaacaatctaacgccatcatgttataaaaaagcaagacctaacataaaaatgttagaaagtgctggatctaacaacatttccgtggtaactttttcacatgtcccaagtgattcccgccagctcacaagaaaagcgtcgtgagcgcatcgtttcttatgtcacccgtcatggattcgctcgtgttgaagcattagctgagctttttgaggtcagcgcaatgaccattcaccgtgatttggaggcgctggctgcagacaatttggtggagcgcattaggggtggcgcgcgttcggtgtcgccgtcgatgagtgagttggcagtggagcagcgtcggcatttgcatcgcactgttaaagaggcgttgtgtactgcagcagcacggttgattccggagggcgctgtggtggcgattgatgattccaccacgttggagtctttggttgagaagttgccgcagcggtcaccatcggcgttgattacgcattctttgaagacaatggcggatcatcgtgtgcgcgccgggatgagcgatatccgtttgattgcgtgtgcgggattgtatttcgcggagactgattctttcttgggcaaggcaacttcagcgcagttgaatgagctgtcggcggatatttcttttgtttctacgactgcggtgcgcgctacgggggaggttccggcgctgtttcatcctgatatggaggctgctgatacgaagcgggcgttgattgggattggtagcgtgcgtgtgttggtggtggattctagtaaatttggttcggctggtgtgttcaaggttgcttcgattgaggagtttgaccacatcatcattgatcagcagtgcacccgtgagcagcgggatcttttgcgtaattcgcgcgcgcagatccatgtgattgaccacaatggtgatgaaattttggataccccaacggaagaggatttttaagatggctttggttcttggaa

SEQ ID NO: 196 - protein, 282 aa, Corynebacterium glutamicum
MSQVIPASSQEKRRERIVSYVTRHGFARVEALAELFEVSAMTIHRDLEALAADNLVERIRGGARSVSPSMSELAVEQRRHLHRTVKEALCTAAARLIPEGAVVAIDDSTTLESLVEKLPQRSPSALITHSLKTMADHRVRAGMSDIRLIACAGLYFAETDSFLGKATSAQLNELSADISFVSTTAVRATGEVPALFHPDMEAADTKRALIGIGSVRVLVVDSSKFGSAGVFKVASIEEFDHIIIDQQCTREQRDLLRNSRAQIHVIDHNGDEILDTPTEEDF

SEQ ID NO: 197 - DNA, 887 bp, Corynebacterium glutamicum
  CDS (1)..(864): RXN01891
ggtggccactatggtttgcctttcgctcgctccactgtcctcttctactacaacaaggatctgtgggctaaggctggcctggaagatcgtggcccagagtcatgggaagagttctccgagtggggtccaaagctgcaggaagcgatggacagtggtttcgcacacggttggggagatgcaaccaactacctttcttggactttcgaaggcccaatgtggtccctcggcggcaactactctgaaggttgggagtcccgtctgactaccccagagaccatccgtgcagttgagtggctcaagtccaccgttgatgaaggtttcgcaaccgtctccaccgacgtcaccaacgagttcgcaaccggcctgatcggttcatgcatccagtccaccggtgatctgtcttcggttgccggcgctgcaagcttcgactggggcgtagcagcacttcctaacccaaccggcgagggcgcttgcccaaccggtggcgcaggcctgggaatcccatctggcatctctgagcagcgtcaggacaacgccctgaagttcatcgacttcctcaccaacgccgcgaacactggctactggtcccgcgagaccggttatgttccagttcgtaaggatgctgcatctgatccagatcacgcagcattcctcgaggagaaccctgcatacaacgttgcagtggagcagcttcctgatacccgttcccaggacaacttccgcgtgctgctgccaaacggtgaccgcaccatcggtgacgcactggagaagatctgcctgactggtgcagacatcgatgtcaccctggctgaggttgagaccaagctgaacaccatctacacccgcgacatcgaaccacttatttaatccgagcacttcagctacac

SEQ ID NO: 198 - protein, 288 aa, Corynebacterium glutamicum
GGHYGLPFARSTVLFYYNKDLWAKAGLEDRGPESWEEFSEWGPKLQEAMDSGFAHGWGDATNYLSWTFEGPMWSLGGNYSEGWESRLTTPETIRAVEWLKSTVDEGFATVSTDVTNEFATGLIGSCIQSTGDLSSVAGAASFDWGVAALPNPTGEGACPTGGAGLGIPSGISEQRQDNALKFIDFLTNAANTGYWSRETGYVPVRKDAASDPDHAAFLEENPAYNVAVEQLPDTRSQDNFRVLLPNGDRTIGDALEKICLTGADIDVTLAEVETKLNTIYTRDIEPLI

SEQ ID NO: 199 - DNA, 842 bp, Corynebacterium glutamicum
  CDS (1)..(819): FRXA01891
tactacaacaaggatctgtgggctaaggctggcctggaagatcgtggcccagagtcatgggaagagttctccgagtggggtccaaagctgcaggaagcgatggacagtggtttcgcacacggttggggagatgcaaccaactacctttcttggactttcgaaggcccaatgtggtccctcggcggcaactactctgaaggttgggagtcccgtctgactaccccagagaccatccgtgcagttgagtggctcaagtccaccgttgatgaaggtttcgcaaccgtctccaccgacgtcaccaacgagttcgcaaccggcctgatcggttcatgcatccagtccaccggtgatctgtcttcggttgccggcgctgcaagcttcgactggggcgtagcagcacttcctaacccaaccggcgagggcgcttgcccaaccggtggcgcaggcctgggaatcccatctggcatctctgagcagcgtcaggacaacgccctgaagttcatcgacttcctcaccaacgccgcgaacactggctactggtcccgcgagaccggttatgttccagttcgtaaggatgctgcatctgatccagatcacgcagcattcctcgaggagaaccctgcatacaacgttgcagtggagcagcttcctgatacccgttcccaggacaacttccgcgtgctgctgccaaacggtgaccgcaccatcggtgacgcactggagaagatctgcctgactggtgcagacatcgatgtcaccctggctgaggttgagaccaagctgaacaccatctacacccgcgacatcgaaccacttatttaatccgagcacttcagctacac

SEQ ID NO: 200 - protein, 273 aa, Corynebacterium glutamicum
YYNKDLWAKAGLEDRGPESWEEFSEWGPKLQEAMDSGFAHGWGDATNYLSWTFEGPMWSLGGNYSEGWESRLTTPETIRAVEWLKSTVDEGFATVSTDVTNEFATGLIGSCIQSTGDLSSVAGAASFDWGVAALPNPTGEGACPTGGAGLGIPSGISEQRQDNALKFIDFLTNAANTGYWSRETGYVPVRKDAASDPDHAAFLEENPAYNVAVEQLPDTRSQDNFRVLLPNGDRTIGDALEKICLTGADIDVTLAEVETKLNTIYTRDIEPLI

SEQ ID NO: 201 - DNA, 776 bp, Corynebacterium glutamicum
  CDS (7)..(753): RXA02414
tttaccatgagttacaacagcccgtataacaacacgaatttcagcaccactggcgcgttccaacctgctggtgggccggtgaagccgtggaataagcccgatgccagcctgaatcagcagctgaaaaacaaatcccgtgtgcgcacaggtcttaccatcgccatcggttatgtagtggtgatttgggcggtgcatttggcatccatcgtcattgcgctgctcactggcttcaacctgaccaactttggtattcatccgctggataccagtgcactgtggggtattttcacctcaccgctgttgcatggaagcttcagccacctcattggaaataccgttccaggctttatattcagtttcctcatcggtatgagtggcaagcgcgtgttctgggaagtcacgattatcgcaggtctcatcggcggtcttggtacatggattttcggtggaatcggcaccaaccacatcggtgcgtccggcctgatttatggctggcttggctacctgatcgtgcgtggaattttcaacaaggatattaaacagttcctgcttggcatagttttggcgttcatttactccggtttgttctggggtctgctacctactcaaatcggtgtgtcctggcagggccaccttttcggtgcacttggtggaatcggtgcgggtgcttttatcgcctcggatgacccggcagcgttgaaagcgaagaagcaacagaagaaattagaaaagcaacaacgccaaagaggcttatagttttcacctagcgactacac

SEQ ID NO: 202 - protein, 249 aa, Corynebacterium glutamicum
MSYNSPYNNTNFSTTGAFQPAGGPVKPWNKPDASLNQQLKNKSRVRTGLTIAIGYVVVIWAVHLASIVIALLTGFNLTNFGIHPLDTSALWGIFTSPLLHGSFSHLIGNTVPGFIFSFLIGMSGKRVFWEVTIIAGLIGGLGTWIFGGIGTNHIGASGLIYGWLGYLIVRGIFNKDIKQFLLGIVLAFIYSGLFWGLLPTQIGVSWQGHLFGALGGIGAGAFIASDDPAALKAKKQQKKLEKQQRQRGL

SEQ ID NO: 203 - DNA, 840 bp, Corynebacterium glutamicum
  CDS (101)..(817): RXN01580
cggtaaacgcctcattaaagtccaatgccatgctcataacactaacagttaaccgtgcggtcaactttgctccctatccttaaaaagcccacagaaaaggatgtataagaatatgcacattgttgcccatcgcggtgcggaagatctgcacctcgaaaacaccatgaccgctttccaggctgccgcgcccgctgacgcttttgagctggatatccacgccaccgctgacaatcaggtcgtcgttatccacgaccgcaccgcagcgcgtgttgccgcgccagattccctgcaccgcgacaccccggttgcgcgcttaagcgccgcgcaaatcaaggagataacgcttatcgacggatcccccgtaccaaccctggaggaagttctactccagacgagcctgccgatccaagtggaaatcaaatctgccggtgcagttccagcagccgcagcattattgcagaaatacccagagcacctggagcgcctgctgttcatcagtttcatcgatgcagcactggtggaaatcgtggatcgactgccagaagctcgcgtgggaatcttgcgcgatgcgtccatggatgatctgcgcattcttgattacatcccgctaaaaaatgtgggcgcgatcttgccctcgtggaaagcactaaacgtggcgtcaattgctgatctacataccaagggaatcaaggttggctgctggacaattcgggatgaaaatgcgtttgggatcgcacaacaagctggcgttgattacgccactgttagcgatccctctcgtttcctcgcgccctcccctgctggggagttgcactggtaaataatctagtgaccagactg

SEQ ID NO: 204 - protein, 239 aa, Corynebacterium glutamicum
MYKNMHIVAHRGAEDLHLENTMTAFQAAAPADAFELDIHATADNQVVVIHDRTAARVAAPDSLHRDTPVARLSAAQIKEITLIDGSPVPTLEEVLLQTSLPIQVEIKSAGAVPAAAALLQKYPEHLERLLFISFIDAALVEIVDRLPEARVGILRDASMDDLRILDYIPLKNVGAILPSWKALNVASIADLHTKGIKVGCWTIRDENAFGIAQQAGVDYATVSDPSRFLAPSPAGELHW

SEQ ID NO: 205 - DNA, 1314 bp, Corynebacterium glutamicum
  CDS (101)..(1291): RXA01436
gcctaaacaaaccagtcaacgacctttcccgtggcgcaacagtccctgacatcgtcaacacagtagccatcacagcaattcaggcaggaggacgcagctaatggcattggcacttgttttgaactccggttcatcttccatcaaattccagctggtcaaccccgaaaactctgccatcgacgagccatatgtttctggtcttgtggagcagattggtgagccaaacggccgcatcgtactcaaaatagagggtgaaaaatataccctagagacacccatcgcagatcactccgaaggcctaaacctggcgttcgatctcatggaccagcacaactgtggtccttcccaactggaaatcaccgcagttggacaccgcgtggtccacggcggaatcttgttctccgcaccggaacttatcactgatgaaatcgtggaaatgatccgcgatctcattccactcgcaccactgcacaaccctgcaaacgttgacggcattgatgttgctcgaaaaattctccccgatgtcccacacgtagctgtctttgacaccggtttcttccactcacttccaccagcagctgcgctgtatgccatcaacaaggatgtcgcagctgaacacggaatcaggcgctatggtttccacggcacctcccatgaatttgtgtccaagcgcgtggtggaaattctggaaaagcccaccgaagacatcaacaccatcaccttccacctgggcaacggcgcatccatggctgctgttcaaggtggccgtgcggtagatacttccatgggtatgacacctctcgcgggccttgtcatgggtacccgaagcggtgacattgatccaggtatcgtcttccacctttcccgcaccgctggcatgagcatcgatgagatcgataatctgctgaacaaaaagtcgggtgtaaagggactttccggtgttaatgatttccgtgaactgcgggaaatgatcgacaacaatgatcaagatgcctggtccgcgtacaacatttacatacaccaactccgccgctacctcggttcctacatggtggcactgggacgggtagacaccatcgtgttcaccgccggtgtcggtgaaaatgcccagtttgtccgtgaggatgccttggcaggtttggaaatgtacggaattgagatcgatccagagcgtaacgcattgccaaacgatggtcctcgattgatttccaccgatgcctccaaggtgaaggtgtttgttattccaactaatgaagagttagctatcgctaggtacgcggtgaagttcgcttagctctcctggttaggatccac

SEQ ID NO: 206 - protein, 397 aa, Corynebacterium glutamicum
MALALVLNSGSSSIKFQLVNPENSAIDEPYVSGLVEQIGEPNGRIVLKIEGEKYTLETPIADHSEGLNLAFDLMDQHNCGPSQLEITAVGHRVVHGGILFSAPELITDEIVEMIRDLIPLAPLHNPANVDGIDVARKILPDVPHVAVFDTGFFHSLPPAAALYAINKDVAAEHGIRRYGFHGTSHEFVSKRVVEILEKPTEDINTITFHLGNGASMAAVQGGRAVDTSMGMTPLAGLVMGTRSGDIDPGIVFHLSRTAGMSIDEIDNLLNKKSGVKGLSGVNDFRELREMIDNNDQDAWSAYNIYIHQLRRYLGSYMVALGRVDTIVFTAGVGENAQFVREDALAGLEMYGIEIDPERNALPNDGPRLISTDASKVKVFVIPTNEELAIARYAVKFA

SEQ ID NO: 207 - DNA, 927 bp, Corynebacterium glutamicum
  CDS (101)..(904): RXA00686
ataggcttgaacaatacgtcgttacactggccgatttgatacctttcaaaacttttacccttcatcggagtgccaggggaacttagaggagcattaaataatggcgggaggaaatcgcgaacctggacgtacagtcacctccaaggtgatcgccgtactgggagcttttgaacacaccatgcgtccacttggtgtcactgaaatcgctgagctggcagacctcccaccaagtaccacccaccgtctcgtttctgaattaaccgaaggcggactactcagcaagaaatctgatgggcgctaccaattgggcttacgtatctgggaactcgcccaaaatacaggacggcagttacgcgacactgcacgcccgttcatccaagagctctactcacttacttccgagactgcgcagctagtggtccgcgataaagatgaagcacttttgattgaccgagcctacggcacgaagaaaattccacgctcggctcgagtcggtggtcgactacctctgaactccactgcggttggcaagattctccttgcgtttgatgagccatgggtaaaacagtcctatctcaagctgccactcaacgcctccaccccaaagacaattgtgaatcccgacgtcttggctgcgcagctgaaacaaattcactcgcaaggctttgccatcacacatgacgagcaacgaatcggcggcgcatcgatcgccgtaccggtctggcatacaggaaaactgggagcagcactggggttggtggttcccaccgcacaggctgcaaatcttgagcgctatctcccgatccttcaggcgacaagtcagagaattacaaaagcaaccgcgctcattcctttggacacacttttggcttcacacaaaaatgcagaacgaaaaggcgatacctaaacccgccctccatctgcata

SEQ ID NO: 208 - protein, 268 aa, Corynebacterium glutamicum
MAGGNREPGRTVTSKVIAVLGAFEHTMRPLGVTEIAELADLPPSTTHRLVSELTEGGLLSKKSDGRYQLGLRIWELAQNTGRQLRDTARPFIQELYSLTSETAQLVVRDKDEALLIDRAYGTKKIPRSARVGGRLPLNSTAVGKILLAFDEPWVKQSYLKLPLNASTPKTIVNPDVLAAQLKQIHSQGFAITHDEQRIGGASIAVPVWHTGKLGAALGLVVPTAQAANLERYLPILQATSQRITKATALIPLDTLLASHKNAERKGDT

SEQ ID NO: 209 - DNA, 1158 bp, Corynebacterium glutamicum
  CDS (101)..(1135): RXA00246
ttgcaaggattgtaatttaaggcacatctatgtcggtgtgaaattacatgtgccagaagagcaatttgccaagtaatccaagcgagaaggagtgagttttatgaccactgctgcaccccaagaatttaccgctgctgttgttgaaaaattcggtcatgacgtgaccgtgaaggatattgaccttccaaagccagggccacaccaggcattggtgaaggtactcacctccggcatctgccacaccgacctccacgccttggagggcgattggccagtaaagccggaaccaccattcgtaccaggacacgaaggtgtaggtgaagttgttgagctcggaccaggtgaacacgatgtgaaggtcggcgatattgtcggcaatgcgtggctctggtcagcgtgtggcacctgcgaatactgcatcaccggcagggaaactcagtgcaacgaagctgagtatggtggctacacccaaaatggatccttcggccagtacatgctggtggatacccgttacgccgctcgcatcccagacggcgtggactacctcgaagcagcaccaattctgtgtgcaggcgtgactgtctacaaggcactcaaagtctctgaaacccgcccgggccaattcatggtgatctccggtgtcggcggacttggccacatcgcagtccaatacgcagcggcgatgggcatgcgtgtcattgcggtagatattgccgatgacaagctggaacttgcccgtaagcacggtgcggaatttaccgtgaatgcgcgtaatgaagattcaggcgaagctgtacagaagtacaccaacggtggcgcacacggcgtgcttgtgactgcagttcacgaggcagcattcggccaggcactggatatggctcgacgtgcaggaacaattgtgttcaacggtctgccaccgggagagttcccagcatccgtgttcaacatcgtattcaagggcctgaccatccgtggatccctcgtgggaacccgccaagacttggccgaagcgctcgatttctttgcacgcggactaatcaagccaaccgtgagtgagtgctccctcgatgaggtcaatggtgtgcttgaccgcatgcgaaacggcaagatcgatggtcgtgtggcgattcgtttctaacggattgtgttgaaactgct

SEQ ID NO: 210 - protein, 345 aa, Corynebacterium glutamicum
MTTAAPQEFTAAVVEKFGHDVTVKDIDLPKPGPHQALVKVLTSGICHTDLHALEGDWPVKPEPPFVPGHEGVGEVVELGPGEHDVKVGDIVGNAWLWSACGTCEYCITGRETQCNEAEYGGYTQNGSFGQYMLVDTRYAARIPDGVDYLEAAPILCAGVTVYKALKVSETRPGQFMVISGVGGLGHIAVQYAAAMGMRVIAVDIADDKLELARKHGAEFTVNARNEDSGEAVQKYTNGGAHGVLVTAVHEAAFGQALDMARRAGTIVFNGLPPGEFPASVFNIVFKGLTIRGSLVGTRQDLAEALDFFARGLIKPTVSECSLDEVNGVLDRMRNGKIDGRVAIRF

SEQ ID NO: 211 - DNA, 723 bp, Corynebacterium glutamicum
  CDS (101)..(700): RXA01571
aaactacctgctgagagctttgtaatttacggtgtggttgtggaggggtgcgtcgagaagcgctcgtaggcgcttttgatttttcggtaggctaactggggtgagtatctcagtaaaagcactacaaaagtccggcccagaagcacctttcgaggtcaagatcattgaacgccgtgacccacgcgcagatgatgtggttattgatatcaaagctgcgggcatctgccacagcgatatccacaccatccgcaacgaatggggcgaggcgcacttcccgctcaccgtcggccacgaaatcgcaggcgttgtctctgcggttggatccgatgtaaccaaatggaaagtcggcgaccgcgtgggcgtcggctgcctcgttaactcctgcggcgaatgcgaacagtgcgtcgcaggatttgaaaacaactgccttcgcggaaacgtcggaacctacaactctaacgacgtcgacggcaccatcacccaaggcggctacgctgaaaaggtagtggtcaacgaacgtttcctgtgcagcatcccagaggaacttaacttcgatgtcgcagcaccactgctgtgcgcaggcatcaccacctactccccaatcgctcgctggaacgttaaagaaggcgacaaagtagcagtcatgggcctcggcgggactcggacacatgggtgtccagatcgctgcagccaagggtgctgaggttaccgttctgtcccgtt

SEQ ID NO: 212 - protein, 200 aa, Corynebacterium glutamicum
VSISVKALQKSGPEAPFEVKIIERRDPRADDVVIDIKAAGICHSDIHTIRNEWGEAHFPLTVGHEIAGVVSAVGSDVTKWKVGDRVGVGCLVNSCGECEQCVAGFENNCLRGNVGTYNSNDVDGTITQGGYAEKVVVNERFLCSIPEELNFDVAAPLLCAGITTYSPIARWNVKEGDKVAVMGLGGTRTHGCPDRCSQGC

SEQ ID NO: 213 - DNA, 615 bp, Corynebacterium glutamicum
  CDS (101)..(592): RXA01572
ctgctgtgcgcaggcatcaccacctactccccaatcgctcgctggaacgttaaagaaggcgacaaagtagcagtcatgggcctcggcgggactcggacacatgggtgtccagatcgctgcagccaagggtgctgaggttaccgttctgtcccgttccctgcgcaaggcagaacttgccaaggaactcggcgcagctcgcacgcttgcgacttctgatgaggatttcttcaccgaacacgccggtgaattcgacttcatcctcaacaccattagcgcatccatcccagtcgacaagtacctgagccttctcaagccacacggtgtcatggctgttgtcggtctgccaccagagaagcagccactgagcttcggtgcgctcatcggcggcggaaaagtcctcaccggatccaacattggcggcatccctgaaacccaggaaatgctcgacttctgtgcaaaacacggcctcggtgcgatgatcgaaactgtcggcgtcaacgatgttgatgcagcctacgaccgtgttgttgccggcgacgttcagttccgcgttgtcattgatactgcttcgtttgctgaggttgaggcggtttaggtttactgaagttcagactt

SEQ ID NO: 214 - protein, 164 aa, Corynebacterium glutamicum
MGVQIAAAKGAEVTVLSRSLRKAELAKELGAARTLATSDEDFFTEHAGEFDFILNTISASIPVDKYLSLLKPHGVMAVVGLPPEKQPLSFGALIGGGKVLTGSNIGGIPETQEMLDFCAKHGLGAMIETVGVNDVDAAYDRVVAGDVQFRVVIDTASFAEVEAV

SEQ ID NO: 215 - DNA, 1140 bp, Corynebacterium glutamicum
  CDS (101)..(1117): RXA01758
cccccttattcagagtgatggtctaccggagaagtacccagaccaatagcatcgaccaacgatagcgcgctcagaagttctttagtgaaagcagaaccaaatgcccaaatacattgccatgcaggtatccgaatccggtgcaccgttagccgcgaatctcgtgcaacctgctccgttgaaatcgagggaagtccgcgtggaaatcgctgctagtggtgtgtgccatgcagatattggcacggcagcagcatcggggaagcacactgtttttcctgttacccctggtcatgagattgcaggaaccatcgcggaaattggtgaaaacgtatctcggtggacggttggtgatcgcgttgcaatcggttggtttggtggcaattgcggtgactgcgctttttgtcgtgcaggtgatcctgtgcattgcagagagcggaagattcctggcgtttcttatgcgggtggttgggcacagaatattgttgttccagcggaggctcttgctgcgattccagatggcatggacttttacgagcccgccccgatgggctgcgcaggtgtgacaacattcaatgcgttgcgaaacctgaagctggatcccggtgcggctgtcgcggtctttggaatcggcggtttagtgcgcctagctattcagtttgctgcgaaaatgggttatcgaaccatcaccatcgcccgcggtttagagcgtgaggagctagctaggcaacttggcgccaaccactacatcgatagcaatgatctgcaccctggccaggcgttatttgaacttggcggggctgacttgatcttgtctactgcgtccaccacggagcctctttcggagttgtctaccggtctttctattggcgggcagctaaccattatcggagttgatgggggagatatcaccgtttcggcagcccaattgatgatgaaccgtcagatcatcacaggtcacctcactggaagtgcgaatgacacggaacagactatgaaatttgctcatctccatggcgtgaaaccgcttattgaacggatgcctctcgatcaagccaacgaggctattgcacgtatttcagctggtaaaccacgtttccgtattgtcttggagccgaattcataatgccaacagcaagcccaatt

SEQ ID NO: 216 - protein, 339 aa, Corynebacterium glutamicum
MPKYIAMQVSESGAPLAANLVQPAPLKSREVRVEIAASGVCHADIGTAAASGKHTVFPVTPGHEIAGTIAEIGENVSRWTVGDRVAIGWFGGNCGDCAFCRAGDPVHCRERKIPGVSYAGGWAQNIVVPAEALAAIPDGMDFYEPAPMGCAGVTTFNALRNLKLDPGAAVAVFGIGGLVRLAIQFAAKMGYRTITIARGLEREELARQLGANHYIDSNDLHPGQALFELGGADLILSTASTTEPLSELSTGLSIGGQLTIIGVDGGDITVSAAQLMMNRQIITGHLTGSANDTEQTMKFAHLHGVKPLIERMPLDQANEAIARISAGKPRFRIVLEPNS

SEQ ID NO: 217 - DNA, 1641 bp, Corynebacterium glutamicum
  CDS (101)..(1618): RXA02539
ggctgctaagcgtgcgaatgtgcgcgttgtcacaatcgttgaccaagtgtcacctgacgcacaggtagtgctcaggtggaggtggcccaaaggagacccaatgactgtctacgcaaatccaggaaccgaaggctcgatcgttaactatgaaaagcgctacgagaactacattggtggcaagtgggttccaccggtagagggccagtaccttgagaacatttcacctgtcactggtgaagttttctgtgaggtcgcacgtggcaccgcagcggacgtggagcttgcactggatgctgcacatgcagccgctgatgcgtggggcaagacttctgtcgctgaacgtgctctgatcctgcaccgcattgcggaccgcatggaagagcacctggaagaaatcgcagttgcagaaacctgggagaacggcaaggcagtccgtgagactcttgctgcagatatcccactggcaatcgaccacttccgctactttgctggcgcgatccgtgctcaggaagatcgttcctcacagatcgaccacaacactgttgcttaccacttcaacgagccaatcggtgttgttggtcagatcattccttggaacttcccaatcctcatggctacctggaagctcgcaccggcacttgctgcaggtaacgcgatcgtcatgaagccagctgagcagaccccagcatccattttgtatctgattaacatcatcggcgatctcatcccagagggcgtcctcaacatcgtcaacggactcggcggtgaagcaggcgctgcactgtccggctctaatcggattggcaagattgctttcaccggttccaccgaggtcggcaagctgatcaaccgcgctgcatccgacaagatcattcctgtcaccctggagctcggcggtaagtccccatccatcttcttctccgatgttctgtcacaggatgacgccttcgcagagaaggcagttgaaggcttcgcgatgttcgccctcaatcagggtgaagtttgtacctgtccttcccgtgcacttgttcatgagtccatcgctgatgaattcctcgagcttggcgtgaagcgagttcagaacatcaagctgggtaacccacttgatactgaaaccatgatgggtgctcaggcgtcccaggagcagatggacaagatctcctcctacctgaagatcggcccagaagaaggcgctcaaaccctcactggtggcaaggtcaacaaggttgatggcatggagaacggttactacattgagccaaccgttttccgcggcaccaacgacatgaggatcttccgcgaggaaatcttcggaccagtcctttctgttgctaccttcagcgacttcgatgaggccatccgtattgcaaacgacaccaactacggcctcggcgctggtgtctggagccgtgaccaaaacaccatttatcgtgcaggtcgcgcaatccaggctggtcgagtttgggtcaaccagtaccacaactacccagcgcactccgctttcggtggatacaaggagtccggcatcggccgtgagaaccacctcatgatgctgaaccactaccagcagaccaagaacctgttggtctcctacgatccaaacccaaccggactgttctgatctaagcgttaagtcctaga

SEQ ID NO: 218 - protein, 506 aa, Corynebacterium glutamicum
MTVYANPGTEGSIVNYEKRYENYIGGKWVPPVEGQYLENISPVTGEVFCEVARGTAADVELALDAAHAAADAWGKTSVAERALILHRIADRMEEHLEEIAVAETWENGKAVRETLAADIPLAIDHFRYFAGAIRAQEDRSSQIDHNTVAYHFNEPIGVVGQIIPWNFPILMATWKLAPALAAGNAIVMKPAEQTPASILYLINIIGDLIPEGVLNIVNGLGGEAGAALSGSNRIGKIAFTGSTEVGKLINRAASDKIIPVTLELGGKSPSIFFSDVLSQDDAFAEKAVEGFAMFALNQGEVCTCPSRALVHESIADEFLELGVKRVQNIKLGNPLDTETMMGAQASQEQMDKISSYLKIGPEEGAQTLTGGKVNKVDGMENGYYIEPTVFRGTNDMRIFREEIFGPVLSVATFSDFDEAIRIANDTNYGLGAGVWSRDQNTIYRAGRAIQAGRVWVNQYHNYPAHSAFGGYKESGIGRENHLMMLNHYQQTKNLLVSYDPNPTGLF

SEQ ID NO: 219 - DNA, 430 bp, Corynebacterium glutamicum
  CDS (101)..(430): RXN03061
ctgccaccactggtcattgcagaggacactctccgtgatggtcttcaggtgttagtcgcagccctagagcgcgaaaccgcgcaccagaaggtgggctaaagtgtctttgaccttcccagtaatcaaccccagcgatggctccaccatcaccgagctagaaaaccacgattccacccagtggatgtccgcgctctctgatgcagttgcagctggtccttcatgggctgcgaaaactccccgcgaaagatccgtggtactcaccgcaatcttcgaagcactgaccgaacgcgcccaagaacttgcagagatcatccacctggaagctggaaaatccgatgcagaagctcttggtgaagtcgcttatggtgcagaatacttccgttggtttgcggaagaagcagtgcgcctgcccggccgctacggacagtca

SEQ ID NO: 220 - protein, 110 aa, Corynebacterium glutamicum
VSLTFPVINPSDGSTITELENHDSTQWMSALSDAVAAGPSWAAKTPRERSVVLTAIFEALTERAQELAEIIHLEAGKSDAEALGEVAYGAEYFRWFAEEAVRLPGRYGQS

SEQ ID NO: 221 - DNA, 747 bp, Corynebacterium glutamicum
  CDS (101)..(724): RXN03150
tttaacagagtgcgtttcaatgcctgtagtgttccggcaattttgaatgtcgttacggttacccaaggctgaattcctgagctcaccttgtacaagatcagtggaagcccagttcacctctcccctgctcaacaatgggcaaacctgtttccttggtacccgaatccttgctccaaaatcacgttacgcggaagtagtcgatgcattcaccgctttcgctggcagcctgcaggttggagtcacgtcctcccctgacactcagatcggaccgatggcgactgcccggcagcgtgagcgcgtggaatcctacatttcccaaggcaaaaatgctggagcccgcatcactgtcggtggcagccgtccacgagatcttgacgccggattcttcgttgagccaacagtgttcgccgatgtagacaatcgcgcagccattgcccaagatgaaatcttcggaccggtgccctctgttgtttcctaccaagacgatgaacacgccatccaactagccaacgattccgaattcggtctcggcggaactgtctggacgagcgatcccgagcgcggcgctgcattggcccgccgagttcacacaggaaccattggcatcaaccgctatatccctgatcccgccgcaccatttggaggtgtgaaaaacagtggccttggcagagaactcggccccgaaggtcttgcttcctaccaagaaacccaaaccatttatctctaatccaaactgcacctatatat

SEQ ID NO: 222 - protein, 208 aa, Corynebacterium glutamicum
VEAQFTSPLLNNGQTCFLGTRILAPKSRYAEVVDAFTAFAGSLQVGVTSSPDTQIGPMATARQRERVESYISQGKNAGARITVGGSRPRDLDAGFFVEPTVFADVDNRAAIAQDEIFGPVPSVVSYQDDEHAIQLANDSEFGLGGTVWTSDPERGAALARRVHTGTIGINRYIPDPAAPFGGVKNSGLGRELGPEGLASYQETQTIYL

SEQ ID NO: 223 - DNA, 881 bp, Corynebacterium glutamicum
  CDS (1)..(858): RXN01340
aaagtgggggagatcatcgcctccgtctttgatacctttaatatcccgcagggcttggtctcaatcatcaccaccactcgagatgcagagctatcggcagaactcatggctgatcctcgcttggctaaagtcaccttcactggatcaaccaacgtgggacgcatcctggtccgccaatccgcggaccgactgctgcgcacctccatggaactcggcggaaatgcagcttttgttatcgacgaagccgcagacctcgacgaagccgtatccggtgccatcgccgcaaaactccgcaacgccggccaagtatgcatcgcagctaaccgtttcttggttcatgaatcccgcgctgccgaattcacctcaaagctggcgacagccatgcagaacactcccattgggccggtgatttctgcccgccaacgcgaccggatcgcagcactagtggatgaagccatcaccgacggcgcccgcctcatcatcggtggggaggtccccgacggctccggcttcttctatccagccaccatcttggccgatgtccctgcacagtcacggattgtgcatgaggaaatcttcggacctgtggccaccattgccactttcaccgacttggccgaaggcgttgcacaagcaaattccaccgaattcggcctcgcagcctacggattcagcaacaatgtgaaagcaacacagtacatggcggaacacttggaagccggaatggtcggaatcaacagaggcgccatctctgacccagcagcaccttttggcggcatcggacaatccggcttcggcagagaaggcggaaccgaaggaatcgaagaatatctctccgtgcgttacctcgctttgccgtgacacatgagctgtccggtgaa

SEQ ID NO: 224 - protein, 286 aa, Corynebacterium glutamicum
KVGEIIASVFDTFNIPQGLVSIITTTRDAELSAELMADPRLAKVTFTGSTNVGRILVRQSADRLLRTSMELGGNAAFVIDEAADLDEAVSGAIAAKLRNAGQVCIAANRFLVHESRAAEFTSKLATAMQNTPIGPVISARQRDRIAALVDEAITDGARLIIGGEVPDGSGFFYPATILADVPAQSRIVHEEIFGPVATIATFTDLAEGVAQANSTEFGLAAYGFSNNVKATQYMAEHLEAGMVGINRGAISDPAAPFGGIGQSGFGREGGTEGIEEYLSVRYLALP

SEQ ID NO: 225 - DNA, 1686 bp, Corynebacterium glutamicum
  CDS (101)..(1663): RXN01498
cagtggacaactacttggcgggtcttaaatcagctgtgaaggattctgcataagctgggcaccacacgagcatcagaacgcgaaacgaaggtaaaagcccatgatcaaacgtcttcctttaggtccgctgcctaaagaacttcatcagactctgcttgatctgaccgcaaatgcccaagatgcggcgaaagtggaggttatagcgccatttactggcgagaccctcggatttggttttgatggtgatgagcaagacgtcgagcatgcttttgcactttcaagggcagcccagaaaaagtgggtgcacaccacggcagtggaacggaagaagatcttcctgaaggttcatgatctggtattgaaaaaccgtgagctgctcatggacatcgtgcagttggaaacaggcaaaaatcgagcatcggctgccgatgaggtgttggacgttgcgatcaccacccgcttctacgcaaacaatgcaggaaagtttttaaatgacaagaaacgccccggcgcgcttccgatcatcacgaaaaacacacaacagtatgtgcccaagggagtggtcgggcagatcacgccgtggaattaccctttaactttgggagtatctgatgctgttccggcgctgctggcaggaaacgcagtggtggctaaacctgacctcgcgacacctttctcctgcttgatcatggtgcacctgctcattgaagccggtctgccgcgtgatttgatgcaggttgtcaccggccctggcgatattgttggcggtgcgattgcagctcagtgtgatttcctcatgttcactggatccacggccacgggccggatcttgggtcggacaatgggtgagcgtttggtgggtttctctgcggaattaggcggaaagaaccctcttattgtggccaaggatgcagatctggacaaggtggaagctgagcttccgcaggcgtgtttttccaactcggggcaattgtgtgtctccactgaacgtatttatgtcgaggaagacgtgtacgaggaggtgattgcacggtttagcaaggcggcgaaagccatgtccattggtgccggatttgagtggaaatatgagatgggttcgttgatcaatcacgcgcagctggatcgggtgagcacctttgttgatcaggctaaagctgcgggcgccacggtgctgtgcggtggcaagtcacgccctgatattggtcccttcttctatgagcccacggtattggcggatgtcccagagggcaccccactgctcacggaggaagtcttcgggccggtggtgttcatcgaaaaggtagccacactggaagaagccgtcgataaggcaaatggcacgccctacggcctgaatgcgtccgtctttgggtcgtcggaaaccggcaatcttgttgcaggccagctggaagctggcggtatcggtattaatgatggctacgccgcgacgtgggcgagcgtgtccacgcctctgggtggcatgaagcagtcggggctggggcaccgccatggtgcggagggaattacaaaatatgcggagatccgaaacatcgcggagcagcgctggatgtctatgcgtgggccggccaaaatgccgcgaaaggtgtactcagacaccgtggccacagcgctaaagctgggcaaaatctttaaagttttgccgtagcaaaaagccggacccttgct

SEQ ID NO: 226 - protein, 521 aa, Corynebacterium glutamicum
MIKRLPLGPLPKELHQTLLDLTANAQDAAKVEVIAPFTGETLGFGFDGDEQDVEHAFALSRAAQKKWVHTTAVERKKIFLKVHDLVLKNRELLMDIVQLETGKNRASAADEVLDVAITTRFYANNAGKFLNDKKRPGALPIITKNTQQYVPKGVVGQITPWNYPLTLGVSDAVPALLAGNAVVAKPDLATPFSCLIMVHLLIEAGLPRDLMQVVTGPGDIVGGAIAAQCDFLMFTGSTATGRILGRTMGERLVGFSAELGGKNPLIVAKDADLDKVEAELPQACFSNSGQLCVSTERIYVEEDVYEEVIARFSKAAKAMSIGAGFEWKYEMGSLINHAQLDRVSTFVDQAKAAGATVLCGGKSRPDIGPFFYEPTVLADVPEGTPLLTEEVFGPVVFIEKVATLEEAVDKANGTPYGLNASVFGSSETGNLVAGQLEAGGIGINDGYAATWASVSTPLGGMKQSGLGHRHGAEGITKYAEIRNIAEQRWMSMRGPAKMPRKVYSDTVATALKLGKIFKVLP

SEQ ID NO: 227 - DNA, 1575 bp, Corynebacterium glutamicum
  CDS (101)..(1552): RXN02674
atcgacctctagggcagcagtgattgatttcataaaaatcacaagtttgtaactaaaggtacagttggtgaagtatccacaatcaactttaggagaccttgtgactgcaacatttgctggaatcgacgccaccaaacacctcatcggaggtcagtgggtggagggaaactcggatcgaatttccaccaatatcaatccttacgacgattccgtaatcgccgaaagcaaacaagcttccattgctgatgttgatgccgcgtatgaagccgcgaagaaggcccaggctgagtgggcagctacgcccgctgcggaacgatctgccatcatctaccgtgcggctgaacttcttgaagagcaccgggaggaaatcgtggaatggctgatcaaggaatccggctcgacgcgttccaaggctaatttggaaatcactttggcaggaaacatcactaaagaatcggcttcattccctggtcgtgtgcatggtcgaatttctccttcgaatactccgggcaaagaaaaccgtgtgtaccgcgtagccaagggcgttgtcggagtgattagtccatggaatttcccactgaacctctcgatccgctcggttgctccggcactagccgtgggcaacgccgtagtgattaagcctgcgagtgataccccagttactggtggtgtaattcctgcacgaatctttgaggaggccggagttcctgcaggcgtgatcagcacggttgcgggcgcaggatctgaaatcggtgatcactttgtcacccacgccgtgccaaagctgatttctttcaccggttcaaccccagtcggtcgtcgtgtcggtgagctggcaattaatggtggaccaatgaaaactgttgcactagagctcggtggcaacgcgccgttcgttgtgcttgccgacgccgacatcgacgccgctgcccaggctgccgcagttggcgctttcctacaccagggacagatttgtatgtcaatcaaccgagtcattgttgatgctgcagttcatgatgaattcctagagaagttcgttgaagcagtgaagaacattccaaccggcgatccaagcgcagaaggaacccttgttggacctgtcattaatgacagtcagctcagtggtttgaaggaaaagatcgagttggccaaaaaggaaggcgcaaccgtccaggttgaagggccaattgaaggccgactggttcatccgcatgtgttctctgatgtcacctctgacatggaaatcgctcgtgaggaaatcttcggacctctcatcagcgtgctgaaggccgatgatgaggcacacgcagcagagctggccaatgcttccgactttggtttgagcgcggcagtgtggtcgaaggatattgatcgtgcagcccagtttgctctgcagattgattccggcatggttcacatcaatgacctcaccgtcaacgatgaaccacacgtgatgttcggtggttcaaagaactctggcctcggccgcttcaacggcgattgggcgatcgaggagttcaccacagatcgatggatcggcatcaagcgcagctaattgtttttcgacgtaacccc

SEQ ID NO: 228 - protein, 484 aa, Corynebacterium glutamicum
VTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 229 - DNA, 2034 bp, Corynebacterium glutamicum
  CDS (101)..(2011): RXN00868
cgatgacccagcgcacgcctgggttcgagatacatggaccgggcaagcatttgatgatcgcttgccatatgagaacgcaaacaaggagggataaaatttcatggctgaaacgaagagaatgacagttagccaggcactggttgaattccttggtcaccagtggactgtcgacggcgatatccgcgagcgcaccattccaggcatgttcggaattttcggacacggaaacgttgctggcattggccaggcactcaagcagtacaacgttgaacaacctgagctcatgccgtactaccaggctcgtaatgagcaggcgatggtgcaccagtctgttggatatgcacgcatgcaccgccgtcgtggcacatacgcatctgccgcatctgttggacccggcgcgaccaacctgttaaccggtgcggctcttgctaccaccaaccgtttgccagcgttgctgctgcctagtgatacttttgccacccgcgtggcggatccagtgttgcagcagttggagcagccatgggatatcgggctgacggttaatgatgctttccgccctgtgtctaagttctttgatcgggtgcagcgcccggagcagttgttctctattgcgttggctgcgatgcgtgtgttgactgatcccgcagaaaccggtgcggtcaccattgcgcttccagaagatgtgcaggctgaaatgctcgatgtgccggtggagttcttgcaggatcgtgagtggcacattaggcgcccacgtccagagcgtgctgcgttggctcgtgcgattgaagtcatcaaaaacgctaagaatccgatgatcattgctggtggcggagtgttgtactccgatgcggaaacgcagctgcaggcacttgtggagcagactggcattccagtgggtacctcccaagctggtggtggcgtgttggcgtgggatcatgcacaaaacttaggtggtgtgggtgccaccggaacgttggctgccaaccgcattgcgggtgatgctgatgtgatcatcggtatcggtactcgttacagcgatttcaccaccgcatctcgcactgcgttccaaaaccctgatgtcaccttcatcaacatcaatgttgcttccttcgatgcttacaagcatggcactcagttgcctgtgattgcagatgcacgcgaggcaattgtggagcttgctgaagccctgcagggattcaccgtggcagaggattacgcgcagcgcatcgcgaaggaaaaggctgcgtgggacgcagaagtagataagtcttttgccccctccggtcttgcgctgcctggacagccggagatcatcggcgcggtgcaggcgtcgacaagcgaaaaagacgtcattgtgcaggccgctggatccttgcctggtgacctgcacaagctgtggcgtgtgcgcgatgcgctgggctaccacgtggaatatgcgttctcgtgcatgggctatgaaatcgcgggcggtatcggcgcgaagcgtggacttgatgccgcaggcgatgaccgcgacgtggtgatcatggttggtgatgggtcctacctcatgctcaacactgagctggtcacggccgtggcagaaggtatcaaggtgattgtggtgctcatccaaaaccacggttatgcctccatcggccacctgtctgaaactgtcggttcgcagcgttttggtacttggtaccgcgaatatgacgctgaggcgaaaaacttccagggcgagcagattctgcctgttgacctggcgatgaatgcacgcagctacggcatggatgtcattgaagtggaaccaagcgcgaatgcgatcgaggatctcaaagcagcgatggcaaccgcgaaggcttcggagaaatccaccttcatccacatcaacagcgatccgttgatctacgcaccagacggtgctggttggtgggacgtgccggtgtcggagacgtccactctggatagcaccaacgcggctcgtgaagattacctgaaaaaccaagccctccagcgtccgctgctcggctaaaccagttggctaaaccaaaa

SEQ ID NO: 230 - protein, 637 aa, Corynebacterium glutamicum
MAETKRMTVSQALVEFLGHQWTVDGDIRERTIPGMFGIFGHGNVAGIGQALKQYNVEQPELMPYYQARNEQAMVHQSVGYARMHRRRGTYASAASVGPGATNLLTGAALATTNRLPALLLPSDTFATRVADPVLQQLEQPWDIGLTVNDAFRPVSKFFDRVQRPEQLFSIALAAMRVLTDPAETGAVTIALPEDVQAEMLDVPVEFLQDREWHIRRPRPERAALARAIEVIKNAKNPMIIAGGGVLYSDAETQLQALVEQTGIPVGTSQAGGGVLAWDHAQNLGGVGATGTLAANRIAGDADVIIGIGTRYSDFTTASRTAFQNPDVTFININVASFDAYKHGTQLPVIADAREAIVELAEALQGFTVAEDYAQRIAKEKAAWDAEVDKSFAPSGLALPGQPEIIGAVQASTSEKDVIVQAAGSLPGDLHKLWRVRDALGYHVEYAFSCMGYEIAGGIGAKRGLDAAGDDRDVVIMVGDGSYLMLNTELVTAVAEGIKVIVVLIQNHGYASIGHLSETVGSQRFGTWYREYDAEAKNFQGEQILPVDLAMNARSYGMDVIEVEPSANAIEDLKAAMATAKASEKSTFIHINSDPLIYAPDGAGWWDVPVSETSTLDSTNAAREDYLKNQALQRPLLG

SEQ ID NO: 231 - DNA, 1142 bp, Corynebacterium glutamicum
  CDS (1)..(1119): RXN01143
atcccagttgtcaccaccttgatggctttgggtactttcccagagtctcacgagctgcacatgggtatgccaggcatgcatggcactgtgtccgctgttggtgcactgcagcgcagcgacctgctgattgctatcggctcccgctttgatgaccgcgtcaccggtgacgttgacaccttcgcgcctgacgccaagatcattcacgccgacattgatcctgccgaaatcggcaagatcaagcaggttgaggttccaatcgtgggcgatgcccgcgaagttcttgctcgtctgctggaaaccaccaaggcaagcaaggcagagaccgaggacatctccgagtgggttgactacctcaagggcctcaaggcacgtttcccgcgtggctacgacgagcagccaggcgatctgctggcaccacagtttgtcattgaaaccctgtccaaggaagttggccccgacgcaatttactgcgccggcgttggccagcaccaaatgtgggcagctcagttcgttgactttgaaaagccacgcacctggctcaactccggtggactgggcaccatgggctacgcagttcctgcggcccttggagcaaaggctggcgcacctgacaaggaagtctgggctatcgacggcgacggctgtttccagatgaccaaccaggaactcaccaccgccgcagttgaaggtttccccattaagatcgcactaatcaacaacggaaaacctggggcatgggttcgccaatggcagaccctattctatgaaggacggtactcaaatactaaacttcgtaaccagggcgagtacatgcccgactttgttaccctttctgagggacttggctgtgttgccatccgcgtcaccaaagcggaggaagtactgccagccatccaaaaggctcgagagatcaacgaccgcccagtagtcatcgacttcatcgtcggtgaagacgcacaggtatggccaatggtgtctgctggatcatccaactccgatatccagtacgcactcggattgcgcccattctttgatggtgatgaatctgcagcagaagatcctgccgacattcacgaagccgtcagcgacattgatgccgccgttgaatcgaccgaggcataaggagagacccaagatggcta

SEQ ID NO: 232 - protein, 373 aa, Corynebacterium glutamicum
IPVVTTLMALGTFPESHELHMGMPGMHGTVSAVGALQRSDLLIAIGSRFDDRVTGDVDTFAPDAKIIHADIDPAEIGKIKQVEVPIVGDAREVLARLLETTKASKAETEDISEWVDYLKGLKARFPRGYDEQPGDLLAPQFVIETLSKEVGPDAIYCAGVGQHQMWAAQFVDFEKPRTWLNSGGLGTMGYAVPAALGAKAGAPDKEVWAIDGDGCFQMTNQELTTAAVEGFPIKIALINNGKPGAWVRQWQTLFYEGRYSNTKLRNQGEYMPDFVTLSEGLGCVAIRVTKAEEVLPAIQKAREINDRPVVIDFIVGEDAQVWPMVSAGSSNSDIQYALGLRPFFDGDESAAEDPADIHEAVSDIDAAVESTEA

SEQ ID NO: 233 - DNA, 793 bp, Corynebacterium glutamicum
  CDS (101)..(793): RXN01146
tatttagtaaaggagccagaaagtcgtgaatgtggcagcttctcaacagcccactcccgccacggttgcaagccgtggtcgatccgccgcccctgagcggatgacaggtgcaaaggcaattgttcgatcgctcgaggagcttaacgccgacatcgtgttcggtattcctggtggtgcggtgctaccggtgtatgacccgctctattcctccacaaaggtgcgccacgtcttggtgcgccacgagcagggcgcaggccacgcagcaaccggctacgcgcaggttactggacgcgttggcgtctgcattgcaacctctggcccaggagcaaccaacttggttaccccaatcgctgatgcaaacttggactccgttcccatggttgccatcaccggccaggtcggaagtggcctgctgggtaccgacgctttccaggaagccgatatccgcggcatcaccatgccagtgaccaagcacaacttcatggtcaccaaccctaacgacattccacaggcattggctgaggcattccacctcgcgattactggtcgccctggccctgttctggtggatattcctaaggatgtccagaacgctgaattggatttcgtctggccaccaaagatcgacctgccaggctaccgcccagtttcaacaccacatgctcgccagatcgagcaggcagtcaagctgatcggtgaggccaagaagcccgtcctttacgttggtggtggcgtaatcaaggctgacgcacacgaagagcttcgtgcgttcgctgagtacaccggcatccca

SEQ ID NO: 234 - protein, 231 aa, Corynebacterium glutamicum
MTGAKAIVRSLEELNADIVFGIPGGAVLPVYDPLYSSTKVRHVLVRHEQGAGHAATGYAQVTGRVGVCIATSGPGATNLVTPIADANLDSVPMVAITGQVGSGLLGTDAFQEADIRGITMPVTKHNFMVTNPNDIPQALAEAFHLAITGRPGPVLVDIPKDVQNAELDFVWPPKIDLPGYRPVSTPHARQIEQAVKLIGEAKKPVLYVGGGVIKADAHEELRAFAEYTGIP

SEQ ID NO: 235 - DNA, 639 bp, Corynebacterium glutamicum
  CDS (101)..(616): RXN01144
ggtgatgaatctgcagcagaagatcctgccgacattcacgaagccgtcagcgacattgatgccgccgttgaatcgaccgaggcataaggagagacccaagatggctaattctgacgtcacccgccacatcctgtccgtactcgttcaggacgtagacggaatcatttcccgcgtatcaggtatgttcacccgacgcgcattcaacctcgtgttcctcgtgtctgcaaagaccgaaacacacggcatcaaccgcatcacggttgttgtcgacgccgacgagctcaacattgagcagatcaccaagcagctcaacaagctgatccccgtgctcaaagtcgtgcgacttgatgaagagaccactatcgcccgcgcaatcatgctggttaaggtctctgcggacagcaccaaccgtccgcagatcgtcgacgccgcgaacatcttccgcgcccgagtcgtcgacgtggctccagactctgtggttattgaatccacaggcaccccaggcaagctccgcgcactgcttgacgtgatggaaccattcggaatccgcgaactgatccaatccggacagattgcactcaaccgcggtccgaagaccatggctccggccaagatctaaacagcaattaatctgattgc

SEQ ID NO: 236 - protein, 172 aa, Corynebacterium glutamicum
MANSDVTRHILSVLVQDVDGIISRVSGMFTRRAFNLVFLVSAKTETHGINRITVVVDADELNIEQITKQLNKLIPVLKVVRLDEETTIARAIMLVKVSADSTNRPQIVDAANIFRARVVDVAPDSVVIESTGTPGKLRALLDVMEPFGIRELIQSGQIALNRGPKTMAPAKI

SEQ ID NO: 237 - DNA, 897 bp, Corynebacterium glutamicum
  CDS (101)..(874): RXA02474
tgctggtctattgtggcgaccgagggcctttgaaggttcgacaaactgtataaggccttgaatcttgagaatttattttgaggaagcaagaggaagtgtcatgagcaaagttgcaatggttaccggtggtgcacaaggcatcggtcgtggaatttcagagaagctggcagcagatggtttcgatattgccgtagccgacctgccacaacaggaagaacaagctgcagagaccatcaagttgattgaagctgcaggtcaaaaggctgtattcgttggattagatgtcaccgataaggctaatttcgacagtgcaattgatgaggcagcagagaaacttggcggcttcgatgtgctagtaaacaacgccggcatcgcacaaattaagccacttctggaagtcaccgaagaagacctaaagcagatctactccgtgaacgtttttagcgtattttttggtattcaagcagcatcccgaaagttcgatgagcttggcgtaaaaggcaagatcatcaacgctgcatcaatcgctgctatccaaggtttcccaatcttgagcgcctactccaccaccaaattcgcggttcgtggcctcacccaggctgctgcgcaagaactcgcacccaagggtcacaccgtgaatgcctacgcacctggcatcgtgggcaccggaatgtgggagcaaatcgatgccgagctttccaagatcaacggcaagccaatcggtgagaacttcaaggagtactcctcctcaatcgcattgggccgaccatcagtacctgaggatgtagccggtctggtttcgttcctggcttctgaaaactccaactacatcaccggacaggtcatgcttgtcgacggcggcatgctctacaactaggggttgctttcccgcactca

SEQ ID NO: 238 - protein, 258 aa, Corynebacterium glutamicum
MSKVAMVTGGAQGIGRGISEKLAADGFDIAVADLPQQEEQAAETIKLIEAAGQKAVFVGLDVTDKANFDSAIDEAAEKLGGFDVLVNNAGIAQIKPLLEVTEEDLKQIYSVNVFSVFFGIQAASRKFDELGVKGKIINAASIAAIQGFPILSAYSTTKFAVRGLTQAAAQELAPKGHTVNAYAPGIVGTGMWEQIDAELSKINGKPIGENFKEYSSSIALGRPSVPEDVAGLVSFLASENSNYITGQVMLVDGGMLYN

SEQ ID NO: 239 - DNA, 876 bp, Corynebacterium glutamicum
  CDS (101)..(853): RXA02453
aaccaacaaaggtcatctcaaccggcttaagaaaattctgccagctttctgctgattgaatcgtgccagctcagggcatatctcacctaaagtaaacaccatgaaatcaatcttcatttccggtgcggcgaacggaattggcaaagctgtggcgttgaaatttcttcacgaaggttggctcgttggagcctacgacctcgcggaaatcacctactcacaccccaatcttcgctggggctacctcaatgttcgacagtccgagtcgtgggacaaagccctagaagactttgcgacgcacaccggaggcaccatcgatgtggtggacaataatgccggcgtaattattgagggaccgctgcaggacgcagaggaggggagcgtcgacaagcttcttgcaatcaacgtcaatggcgtgactcttggtgcccgcgccgctcatccttatttggcgcgcacgccgggcgcccagttgttaaacatgtcctcggcgtcggcggtgtacgggcagccccagatcgcggtgtattcggcttcgaagttttacgtcgcaggtcttactgaggcgctgaatttggagtggcggaaagacgatattcgcgtggtcgatgtttggcctttgtgggcgaaaaccgatttggtgaacggcgtgaaggctaagtcactgaagcgtttgggtgtccggatcactccggaacaggtggcacaggcggtatgggatgcggtgcatccgaaatctcggtgggcgaagggaaaggtgcatcacggggtgtcaaagttggataaggcgctgtatctcatgaaatctctgtcgcctgatcgggtagcgatgtgttttgcgcgactaatcgccggataaatgaattgattattttaggc

SEQ ID NO: 240 - protein, 251 aa, Corynebacterium glutamicum
MKSIFISGAANGIGKAVALKFLHEGWLVGAYDLAEITYSHPNLRWGYLNVRQSESWDKALEDFATHTGGTIDVVDNNAGVIIEGPLQDAEEGSVDKLLAINVNGVTLGARAAHPYLARTPGAQLLNMSSASAVYGQPQIAVYSASKFYVAGLTEALNLEWRKDDIRVVDVWPLWAKTDLVNGVKAKSLKRLGVRITPEQVAQAVWDAVHPKSRWAKGKVHHGVSKLDKALYLMKSLSPDRVAMCFARLIAG

SEQ ID NO: 241 - DNA, 1140 bp, Corynebacterium glutamicum; identical to SEQ ID NO: 215
  CDS (101)..(1117): RXS01758

SEQ ID NO: 242 - protein, 339 aa, Corynebacterium glutamicum; identical to SEQ ID NO: 216

SEQ ID NO: 243 - DNA, 1665 bp, Corynebacterium glutamicum
  CDS (101)..(1642): RXA02737
agcacgctgcatcagtaacggcgacatgaaatcgaattagttcgatcttatgtggccgttacacatctttcattaaagaaaggatcgtgacactaccatcgtgagcacaaacacgaccccctccagctggacaaacccactgcgcgacccgcaggataaacgactcccccgcatcgctggcccttccggcatggtgatcttcggtgtcactggcgacttggctcgaaagaagctgctccccgccatttatgatctagcaaaccgcggattgctgcccccaggattctcgttggtaggttacggccgccgcgaatggtccaaagaagactttgaaaaatacgtacgcgatgccgcaagtgctggtgctcgtacggaattccgtgaaaatgtttgggagcgcctcgccgagggtatggaatttgttcgcggcaactttgatgatgatgcagctttcgacaacctcgctgcaacactcaagcgcatcgacaaaacccgcggcaccgccggcaactgggcttactacctgtccattccaccagattccttcacagcggtctgccaccagctggagcgttccggcatggctgaatccaccgaagaagcatggcgccgcgtgatcatcgagaagcctttcggccacaacctcgaatccgcacacgagctcaaccagctggtcaacgcagtcttcccagaatcttctgtgttccgcatcgaccactatttgggcaaggaaacagttcaaaacatcctggctctgcgttttgctaaccagctgtttgagccactgtggaactccaactacgttgaccacgtccagatcaccatggctgaagatattggcttgggtggacgtgctggttactacgacggcatcggcgcagcccgcgacgtcatccagaaccacctgatccagctcttggctctggttgccatggaagaaccaatttctttcgtgccagcgcagctgcaggcagaaaagatcaaggtgctctctgcgacaaagccgtgctacccattggataaaacctccgctcgtggtcagtacgctgccggttggcagggctctgagttagtcaagggacttcgcgaagaagatggcttcaaccctgagtccaccactgagacttttgcggcttgtaccttagagatcacgtctcgtcgctgggctggtgtgccgttctacctgcgcaccggtaagcgtcttggtcgccgtgttactgagattgccgtggtgtttaaagacgcaccacaccagcctttcgacggcgacatgactgtatcccttggccaaaacgccatcgtgattcgcgtgcagcctgatgaaggtgtgctcatccgcttcggttccaaggttccaggttctgccatggaagtccgtgacgtcaacatggacttctcctactcagaatccttcactgaagaatcacctgaagcatacgagcgcctcattttggatgcgctgttagatgaatccagcctcttccctaccaacgaggaagtggaactgagctggaagattctggatccaattcttgaagcatgggatgccgatggagaaccagaggattacccagcgggtacgtggggtccaaagagcgctgatgaaatgctttcccgcaacggtcacacctggcgcaggccataatttaggggcaaaaaatgatc

SEQ ID NO: 244 - protein, 514 aa, Corynebacterium glutamicum
VSTNTTPSSWTNPLRDPQDKRLPRIAGPSGMVIFGVTGDLARKKLLPAIYDLANRGLLPPGFSLVGYGRREWSKEDFEKYVRDAASAGARTEFRENVWERLAEGMEFVRGNFDDDAAFDNLAATLKRIDKTRGTAGNWAYYLSIPPDSFTAVCHQLERSGMAESTEEAWRRVIIEKPFGHNLESAHELNQLVNAVFPESSVFRIDHYLGKETVQNILALRFANQLFEPLWNSNYVDHVQITMAEDIGLGGRAGYYDGIGAARDVIQNHLIQLLALVAMEEPISFVPAQLQAEKIKVLSATKPCYPLDKTSARGQYAAGWQGSELVKGLREEDGFNPESTTETFAACTLEITSRRWAGVPFYLRTGKRLGRRVTEIAVVFKDAPHQPFDGDMTVSLGQNAIVIRVQPDEGVLIRFGSKVPGSAMEVRDVNMDFSYSESFTEESPEAYERLILDALLDESSLFPTNEEVELSWKILDPILEAWDADGEPEDYPAGTWGPKSADEMLSRNGHTWRRP

SEQ ID NO: 245 - DNA, 1203 bp, Corynebacterium glutamicum
  CDS (101)..(1180): RXA02738
ttgttgttaatcggtacaaagggtcttaagcacatcccttacttgcctgctctccttgagcacagttcaagaacaattcttttaaggaaaatttagtttcatgtctcacattgatgatcttgcacagctcggcacttccacttggctcgacgacctctcccgcgagcgcattacttccggcaatctcagccaggttattgaggaaaagtctgtagtcggtgtcaccaccaacccagctattttcgcagcagcaatgtccaagggcgattcctacgacgctcagatcgcagagctcaaggccgctggcgcatctgttgaccaggctgtttacgccatgagcatcgacgacgttcgcaatgcttgtgatctgttcaccggcatcttcgagtcctccaacggctacgacggccgcgtgtccatcgaggttgacccacgtatctctgctgaccgcgacgcaaccctggctcaggccaaggagctgtgggcaaaggttgatcgtccaaacgtcatgatcaagatccctgcaaccccaggttctttgccagcaatcaccgacgctttggctgagggcatcagcgttaacgtcaccttgatcttctccgttgctcgctaccgcgaggtcatcgctgcgttcatcgagggcatcaagcaggctgctgcaaacggccacgacgtctccaagatccactctgtggcttccttcttcgtctcccgcgtcgacgttgagatcgacaagcgcctcgaggcaatcggatccgatgaggctttggctctgcgcggcaaggcaggcgttgccaacgctcagcgcgcttacgctgtgtacaaggagcttttcgacgccgccgagctgcctgaaggtgccaacactcagcgcccactgtgggcatccaccggcgtgaagaaccctgcgtacgctgcaactctttacgtttccgagctggctggtccaaacaccgtcaacaccatgccagaaggcaccatcgacgcggttctggagcagggcaacctgcacggtgacaccctgtccaactccgcggcagaagctgacgctgtgttctcccagcttgaggctctgggcgttgacttggcagatgtcttccaggtcctggagaccgagggtgtggacaagttcgttgcttcttggagcgaactgcttgagtccatggaagctcgcctgaagtagaatcagcacgctgcatcagt

SEQ ID NO: 246 - protein, 360 aa, Corynebacterium glutamicum
MSHIDDLAQLGTSTWLDDLSRERITSGNLSQVIEEKSVVGVTTNPAIFAAAMSKGDSYDAQIAELKAAGASVDQAVYAMSIDDVRNACDLFTGIFESSNGYDGRVSIEVDPRISADRDATLAQAKELWAKVDRPNVMIKIPATPGSLPAITDALAEGISVNVTLIFSVARYREVIAAFIEGIKQAAANGHDVSKIHSVASFFVSRVDVEIDKRLEAIGSDEALALRGKAGVANAQRAYAVYKELFDAAELPEGANTQRPLWASTGVKNPAYAATLYVSELAGPNTVNTMPEGTIDAVLEQGNLHGDTLSNSAAEADAVFSQLEALGVDLADVFQVLETEGVDKFVASWSELLESMEARLK

SEQ ID NO: 247 - DNA, 2223 bp, Corynebacterium glutamicum
  CDS (101)..(2200): RXA02739
cctttgccaaatttgaaccaattaacctaagtcgtagatctgatcatcggatctaacgaaaacgaaccaaaactttggtcccggtttaacccaggaaggattgaccaccttgacgctgtcacctgaacttcaggcgctcactgtacgcaattacccctctgattggtccgatgtggacaccaaggctgtagacactgttcgtgtcctcgctgcagacgctgtagaaaactgtggctccggccacccaggcaccgcaatgagcctggctccccttgcatacaccttgtaccagcgggttatgaacgtagatccacaggacaccaactgggcaggccgtgaccgcttcgttctttcttgtggccactcctctttgacccagtacatccagctttacttgggtggattcggccttgagatggatgacctgaaggctctgcgcacctgggattccttgaccccaggacaccctgagtaccgccacaccaagggcgttgagatcaccactggccctcttggccagggtcttgcatctgcagttggtatggccatggctgctcgtcgtgagcgtggcctattcgacccaaccgctgctgagggcgaatccccattcgaccaccacatctacgtcattgcttctgatggtgacctgcaggaaggtgtcacctctgaggcatcctccatcgctggcacccagcagctgggcaacctcatcgtgttctgggatgacaaccgcatctccatcgaagacaacactgagatcgctttcaacgaggacgttgttgctcgttacaaggcttacggctggcagaccattgaggttgaggctggcgaggacgttgcagcaatcgaagctgcagtggctgaggctaagaaggacaccaagcgacctaccttcatccgcgttcgcaccatcatcggcttcccagctccaactatgatgaacaccggtgctgtgcacggtgctgctcttggcgcagctgaggttgcagcaaccaagactgagcttggattcgatcctgaggctcacttcgcgatcgacgatgaggttatcgctcacacccgctccctcgcagagcgcgctgcacagaagaaggctgcatggcaggtcaagttcgatgagtgggcagctgccaaccctgagaacaaggctctgttcgatcgcctgaactcccgtgagcttccagcgggctacgctgacgagctcccaacatgggatgcagatgagaagggcgtcgcaactcgtaaggcttccgaggctgcacttcaggcactgggcaagacccttcctgagctgtggggcggttccgctgacctcgcaggttccaacaacaccgtgatcaagggctccccttccttcggccctgagtccatctccaccgagacctggtctgctgagccttacggccgtaacctgcacttcggtatccgtgagcacgctatgggatccatcctcaacggcatttccctccacggtggcacccgcccatacggcggaaccttcctcatcttctccgactacatgcgtcctgcagttcgtcttgcagctctcatggagaccgacgcttactacgtctggacccacgactccatcggtctgggcgaagatggcccaacccaccagcctgttgaaaccttggctgcactgcgcgccatcccaggtctgtccgtcctgcgtcctgcagatgcgaacgagaccgcccaggcttgggctgcagcacttgagtacaaggaaggccctaagggtcttgcactgacccgccagaacgttcctgttctggaaggcaccaaggagaaggctgctgaaggcgttcgccgcggtggctacgtcctggttgagggttccaaggaaaccccagatgtgatcctcatgggctccggctccgaggttcagcttgcagttaacgctgcgaaggctctggaagctgagggcgttgcagctcgcgttgtttccgttccttgcatggattggttccaggagcaggacgcagagtacatcgagtccgttctgcctgcagctgtgaccgctcgtgtgtctgttgaagctggcatcgcaatgccttggtaccgcttcttgggcacccagggccgtgctgtctcccttgagcacttcggtgcttctgcggattaccagaccctgtttgagaagttcggcatcaccaccgatgcagtcgtggcagcggccaaggactccattaacggttaattgccctgctgtttttagct

SEQ ID NO: 248 - protein, 700 aa, Corynebacterium glutamicum
LTTLTLSPELQALTVRNYPSDWSDVDTKAVDTVRVLAADAVENCGSGHPGTAMSLAPLAYTLYQRVMNVDPQDTNWAGRDRFVLSCGHSSLTQYIQLYLGGFGLEMDDLKALRTWDSLTPGHPEYRHTKGVEITTGPLGQGLASAVGMAMAARRERGLFDPTAAEGESPFDHHIYVIASDGDLQEGVTSEASSIAGTQQLGNLIVFWDDNRISIEDNTEIAFNEDVVARYKAYGWQTIEVEAGEDVAAIEAAVAEAKKDTKRPTFIRVRTIIGFPAPTMMNTGAVHGAALGAAEVAATKTELGFDPEAHFAIDDEVIAHTRSLAERAAQKKAAWQVKFDEWAAANPENKALFDRLNSRELPAGYADELPTWDADEKGVATRKASEAALQALGKTLPELWGGSADLAGSNNTVIKGSPSFGPESISTETWSAEPYGRNLHFGIREHAMGSILNGISLHGGTRPYGGTFLIFSDYMRPAVRLAALMETDAYYVWTHDSIGLGEDGPTHQPVETLAALRAIPGLSVLRPADANETAQAWAAALEYKEGPKGLALTRQNVPVLEGTKEKAAEGVRRGGYVLVEGSKETPDVILMGSGSEVQLAVNAAKALEAEGVAARVVSVPCMDWFQEQDAEYIESVLPAAVTARVSVEAGIAMPWYRFLGTQGRAVSLEHFGASADYQTLFEKFGITTDAVVAAAKDSING

SEQ ID NO: 249 - DNA, 793 bp, Corynebacterium glutamicum
  CDS (48)..(770): RXA00965
agattgcgggcctcggcttcattgaaaacaagacggtgtttgaataaatgacaactttccacgatcttccgctggaggagcggctgacactggccaggttgggcacatcccactactcccgtcagctctccctcgtggacaacgctgagttcggcgagcattccctgctagaagggtggactcgttcccacctcattgcccacgtggcatacaacgccatcgcactgtgcaacctcatgcactgggcaaatactggtgaggaaaccccaatgtacgtgtcgccagaagcgcgcaacgaggaaattgcctacggttccacgctcaatcccgatgcgttgcgtaacctgcatgaacactccgtcgcacgcctggacgtggcttggcgtgaaacgtctgaagatgcttggtcacacgaggttctgacagctcagggacgcactgtcccagctagtgaaacattgtggatgcgttcccgcgaagtctggatccacgcagttgacctcggtgcagtggcaacctttggcgacatcccagaggtcatcctgcgcaccttagctgcagaaatcacacaaaagtggacaagccaaggagccggcgagggacttgtgcttctcgacgagccctccagcactcgctaccccgccgccccagggcaggacgaggtagtagtgtccggtagccttgcaggcattgttcgctacgccgctggccgcggttccgatggagtcacttcttccactggagaggttccagagccaccgcgctggctgtagtttccacacattcttaaatg

SEQ ID NO: 250 - protein, 241 aa, Corynebacterium glutamicum
MTTFHDLPLEERLTLARLGTSHYSRQLSLVDNAEFGEHSLLEGWTRSHLIAHVAYNAIALCNLMHWANTGEETPMYVSPEARNEEIAYGSTLNPDALRNLHEHSVARLDVAWRETSEDAWSHEVLTAQGRTVPASETLWMRSREVWIHAVDLGAVATFGDIPEVILRTLAAEITQKWTSQGAGEGLVLLDEPSSTRYPAAPGQDEVVVSGSLAGIVRYAAGRGSDGVTSSTGEVPEPPRWL

SEQ ID NO: 251 - DNA, 1575 bp, Corynebacterium glutamicum
  CDS (101)..(1552): RXN00999
cctcctgtgacctggtaaaatcgccactacccccaaatggtcacaccttttaggccgattttgctgacaccgggctatgccgtcaagtacgatcaataacatgactaatggagataatctcgcacagatcggcgttgtaggcctagcagtaatgggctcaaacctcgcccgcaacttcgcccgcaacggcaacactgtcgctgtctacaaccgcagcactgacaaaaccgacaagctcatcgccgatcacggctccgaaggcaacttcatcccttctgcaaccgtcgaagagttcgtagcatccctggaaaagccacgccgcgccatcatcatggttcaggctggtaacgccaccgacgcagtcatcaaccagctggcagatgccatggacgaaggcgacatcatcatcgacggcggcaacgccctctacaccgacaccattcgtcgcgagaaggaaatctccgcacgcggtctccacttcgtcggtgctggtatctccggcggcgaagaaggcgcactcaacggcccatccatcatgcctggtggcccagcaaagtcctacgagtccctcggaccactgcttgagtccatcgctgccaacgttgacggcaccccatgtgtcacccacatcggcccagacggcgccggccacttcgtcaagatggtccacaacggcatcgagtacgccgacatgcaggtcatcggcgaggcataccaccttctccgctacgcagcaggcatgcagccagctgaaatcgctgaggttttcaaggaatggaacgcaggcgacctggattcctacctcatcgaaatcaccgcagaggttctctcccaggtggatgctgaaaccggcaagccactaatcgacgtcatcgttgacgctgcaggtcagaagggcaccggacgttggaccgtcaaggctgctcttgatctgggtattgctaccaccggcatcggcgaagctgttttcgcacgtgcactctccggcgcaaccagccagcgcgctgcagcacagggcaacctacctgcaggtgtcctcaccgatctggaagcacttggcgtggacaaggcacagttcgtcgaagacgttcgccgtgcactgtacgcatccaagcttgttgcttacgcacagggcttcgacgagatcaaggctggctccgacgagaacaactgggacgttgaccctcgcgacctcgctaccatctggcgcggcggctgcatcattcgcgctaagttcctcaaccgcatcgtcgaagcatacgatgcaaacgctgaacttgagtccctgctgctcgatccttacttcaagagcgagctcggcgacctcatcgattcatggcgtcgcgtgattgtcaccgccacccagcttggcctgccaatcccagtgttcgcttcctccctgtcctactacgacagcctgcgtgcagagcgtctgccagcagccctgatccaaggacagcgcgacttcttcggtgcgcacacctacaagcgcatcgacaaggatggctccttccacaccgagtggtccggcgaccgctccgaggttgaagcttaaaggctctccttttaacacaa

SEQ ID NO: 252 - protein, 484 aa, Corynebacterium glutamicum
MTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDRSEVEA

SEQ ID NO: 253 - DNA, 1537 bp, Corynebacterium glutamicum
  CDS (101)..(1537): FRXA00999
cctcctgtgacctggtaaaatcgccactacccccaaatggtcacaccttttaggccgattttgctgacaccgggctatgccgtcaagtacgatcaataacatgactaatggagataatctcgcacagatcggcgttgtaggcctagcagtaatgggctcaaacctcgcccgcaacttcgcccgcaacggcaacactgtcgctgtctacaaccgcagcactgacaaaaccgacaagctcatcgccgatcacggctccgaaggcaacttcatcccttctgcaaccgtcgaagagttcgtagcatccctggaaaagccacgccgcgccatcatcatggttcaggctggtaacgccaccgacgcagtcatcaaccagctggcagatgccatggacgaaggcgacatcatcatcgacggcggcaacgccctctacaccgacaccattcgtcgcgagaaggaaatctccgcacgcggtctccacttcgtcggtgctggtatctccggcggcgaagaaggcgcactcaacggcccatccatcatgcctggtggcccagcaaagtcctacgagtccctcggaccactgcttgagtccatcgctgccaacgttgacggcaccccatgtgtcacccacatcggcccagacggcgccggccacttcgtcaagatggtccacaacggcatcgagtacgccgacatgcaggtcatcggcgaggcataccaccttctccgctacgcagcaggcatgcagccagctgaaatcgctgaggttttcaaggaatggaacgcaggcgacctggattcctacctcatcgaaatcaccgcagaggttctctcccaggtggatgctgaaaccggcaagccactaatcgacgtcatcgttgacgctgcaggtcagaagggcaccggacgttggaccgtcaaggctgctcttgatctgggtattgctaccaccggcatcggcgaagctgttttcgcacgtgcactctccggcgcaaccagccagcgcgctgcagcacagggcaacctacctgcaggtgtcctcaccgatctggaagcacttggcgtggacaaggcacagttcgtcgaagacgttcgccgtgcactgtacgcatccaagcttgttgcttacgcacagggcttcgacgagatcaaggctggctccgacgagaacaactgggacgttgaccctcgcgacctcgctaccatctggcgcggcggctgcatcattcgcgctaagttcctcaaccgcatcgtcgaagcatacgatgcaaacgctgaacttgagtccctgctgctcgatccttacttcaagagcgagctcggcgacctcatcgattcatggcgtcgcgtgattgtcaccgccacccagcttggcctgccaatcccagtgttcgcttcctccctgtcctactacgacagcctgcgtgcagagcgtctgccagcagccctgatccaaggacagcgcgacttcttcggtgcgcacacctacaagcgcatcgacaaggatggctccttccacaccgagtggtccggcgaccgc

SEQ ID NO: 254 - protein, 479 aa, Corynebacterium glutamicum
MTNGDNLAQIGVVGLAVMGSNLARNFARNGNTVAVYNRSTDKTDKLIADHGSEGNFIPSATVEEFVASLEKPRRAIIMVQAGNATDAVINQLADAMDEGDIIIDGGNALYTDTIRREKEISARGLHFVGAGISGGEEGALNGPSIMPGGPAKSYESLGPLLESIAANVDGTPCVTHIGPDGAGHFVKMVHNGIEYADMQVIGEAYHLLRYAAGMQPAEIAEVFKEWNAGDLDSYLIEITAEVLSQVDAETGKPLIDVIVDAAGQKGTGRWTVKAALDLGIATTGIGEAVFARALSGATSQRAAAQGNLPAGVLTDLEALGVDKAQFVEDVRRALYASKLVAYAQGFDEIKAGSDENNWDVDPRDLATIWRGGCIIRAKFLNRIVEAYDANAELESLLLDPYFKSELGDLIDSWRRVIVTATQLGLPIPVFASSLSYYDSLRAERLPAALIQGQRDFFGAHTYKRIDKDGSFHTEWSGDR

SEQ ID NO: 255 - DNA, 1326 bp, Corynebacterium glutamicum
  CDS (101)..(1303): RXN02596
aaggtatctgggtgtggatatgccctgctaactggagaaacttggcccgatcgggtgtctgaaatttcggcaacgccgaatgtaagttagtgtcgaatgcatgacggaatcgaaaaattacgacttaatcgttgtaggctccggcctcttcgggctcaccgtggctgagcgtgcagctagccagctgggtaagaaagtcctcatcgttgaacgccgctcgcacctcggtggcaatgcttactctgaagcagaaccagagaccggcattgaaatccacaaatacggcgcgcacctcttccacacctccaacacacgcgtgtgggaatacgtcaaccagttcaccagtttcaccggctaccagcaccgcgtcttcgcaatgcacaacggcaccgcctaccaattccccatgggactgggcctgattaaccagttcttcggcaagtactacagcccagatgaagcccgtgagctcatcaaggaacagtctgcagaaatcgattcctccgacgccaccaacctcgaagaaaaggccatttccctcattggtcgcccactttacgaggcattcatccgcgactacaccgcaaagcagtggcagactgatccaaagaacctcccagccggcaacatcacccgcctgccagttcgctacaacttcaacaaccgctatttcaacgacacctacgaaggccttcccacagacggctacgcggcatggttggaaaagatggcagagcatgagcttatcgacgtccgcctcgacaccgactggttcgacgttcgcgatgacctccgcgcaagcaaccccgacgcacctgtggtctacaccggcccactcgacctctacttcaactacgcagagggcaagctgggatggcgcaccctcgactttgaaaccgaagtagtagaaaccggtgacttccaaggaaccccagtgatgaactacaacgatgcggacgtacctttcacccgcatccacgagttccgtcacttccacccagagcgtgatgacagttaccccaaggataagaccgtcatcatgcgcgagttctcccgtttcgcagataacgaggatgagccttattacccaatcaacactccagacgaccgagacatgctgaagcagtaccgccttctggctgctgaagaggctgctaataataaggtgctgttcggcggtcgactgggcacgtaccagtacctcgacatgcacatggctatcggttctgcgctgagcatgtttgacaacaagctggtgccgttctttgaagaaggcacaccgctagagcaggaacgcggacactaaaaggaagggcatctcccaca

SEQ ID NO: 256 - protein, 401 aa, Corynebacterium glutamicum
MTESKNYDLIVVGSGLFGLTVAERAASQLGKKVLIVERRSHLGGNAYSEAEPETGIEIHKYGAHLFHTSNTRVWEYVNQFTSFTGYQHRVFAMHNGTAYQFPMGLGLINQFFGKYYSPDEARELIKEQSAEIDSSDATNLEEKAISLIGRPLYEAFIRDYTAKQWQTDPKNLPAGNITRLPVRYNFNNRYFNDTYEGLPTDGYAAWLEKMAEHELIDVRLDTDWFDVRDDLRASNPDAPVVYTGPLDLYFNYAEGKLGWRTLDFETEVVETGDFQGTPVMNYNDADVPFTRIHEFRHFHPERDDSYPKDKTVIMREFSRFADNEDEPYYPINTPDDRDMLKQYRLLAAEEAANNKVLFGGRLGTYQYLDMHMAIGSALSMFDNKLVPFFEEGTPLEQERGH

SEQ ID NO: 257 - DNA, 512 bp, Corynebacterium glutamicum
  CDS (1)..(489): FRXA02596
cctgtggtctacaccggcccactcgacctctacttcaactacgcagagggcaagctgggatggcgcaccctcgactttgaaaccgaagtagtagaaaccggtgacttccaaggaaccccagtgatgaactacaacgatgcggacgtacctttcacccgcatccacgagttccgtcacttccacccagagcgtgatgacagttaccccaaggataagaccgtcatcatgcgcgagttctcccgtttcgcagataacgaggatgagccttattacccaatcaacactccagacgaccgagacatgctgaagcagtaccgccttctggctgctgaagaggctgctaataataaggtgctgttcggcggtcgactgggcacgtaccagtacctcgacatgcacatggctatcggttctgcgctgagcatgtttgacaacaagctggtgccgttctttgaagaaggcacaccgctagagcaggaacgcggacactaaaaggaagggcatctcccaca

SEQ ID NO: 258 - protein, 163 aa, Corynebacterium glutamicum
PVVYTGPLDLYFNYAEGKLGWRTLDFETEVVETGDFQGTPVMNYNDADVPFTRIHEFRHFHPERDDSYPKDKTVIMREFSRFADNEDEPYYPINTPDDRDMLKQYRLLAAEEAANNKVLFGGRLGTYQYLDMHMAIGSALSMFDNKLVPFFEEGTPLEQERGH

SEQ ID NO: 259 - DNA, 598 bp, Corynebacterium glutamicum
  CDS (101)..(598): FRXA02642
aaggtatctgggtgtggatatgccctgctaactggagaaacttggcccgatcgggtgtctgaaatttcggcaacgccgaatgtaagttagtgtcgaatgcatgacggaatcgaaaaattacgacttaatcgttgtaggctccggcctcttcgggctcaccgtggctgagcgtgcagctagccagctgggtaagaaagtcctcatcgttgaacgccgctcgcacctcggtggcaatgcttactctgaagcagaaccagagaccggcattgaaatccacaaatacggcgcgcacctcttccacacctccaacacacgcgtgtgggaatacgtcaaccagttcaccagtttcaccggctaccagcaccgcgtcttcgcaatgcacaacggcaccgcctaccaattccccatgggactgggcctgattaaccagttcttcggcaagtactacagcccagatgaagcccgtgagctcatcaaggaacagtctgcagaaatcgattcctccgacgccaccaacctcgaagaaaaggccatttccctcattggtcgcccactttacgaggcattcatccgcgactacaccgcaaagcagtggcag

SEQ ID NO: 260 - protein, 166 aa, Corynebacterium glutamicum
MTESKNYDLIVVGSGLFGLTVAERAASQLGKKVLIVERRSHLGGNAYSEAEPETGIEIHKYGAHLFHTSNTRVWEYVNQFTSFTGYQHRVFAMHNGTAYQFPMGLGLINQFFGKYYSPDEARELIKEQSAEIDSSDATNLEEKAISLIGRPLYEAFIRDYTAKQWQ

SEQ ID NO: 261 - DNA, 668 bp, Corynebacterium glutamicum
  CDS (1)..(645): RXA02572
gcggtcgctgagatttgcgagccgaccggcgccgatgcggttgcgcttgtggatgccatcggtcacgacgatcgtatcggccgaaagttcttaggcgcgggcctgggattcggtggcggttgtttgcctaaagacatccgcgctttcatggcacgcgcgggcgaattgggtgctgaccaggcattaacgttcttgcgtgaggtcgattccatcaatatgcgtcgtcgcgaccgtgtggtgcagctggccaaagagatgtgtggcggttcgctgctgggcaagcgggttacagtgctcggcgccgcattcaaacccaactcggacgatgtccgcgattctccggcgctgtcggtcgcgggttcgctgtcgctccagggtgcggcggtctcggtctacgacccggaagctatggacaacgctcgacgcgtcttcccgacgctcagctatgcgtccagcactaaagaggcgcttatcgacgcccacctcgtcgttcttgccactgaatggcaagaattccgcgaccttgaccccgaagtggcgggaggggtcgtcgagaagcgcgctattattgatggccgaaacgtcctcgatgttgccaaatggaaggccgccggttgggaaatggaagcgctcggccgcaacctttagtgcggtggatcaggcggggc

SEQ ID NO: 262 - protein, 215 aa, Corynebacterium glutamicum
AVAEICEPTGADAVALVDAIGHDDRIGRKFLGAGLGFGGGCLPKDIRAFMARAGELGADQALTFLREVDSINMRRRDRVVQLAKEMCGGSLLGKRVTVLGAAFKPNSDDVRDSPALSVAGSLSLQGAAVSVYDPEAMDNARRVFPTLSYASSTKEALIDAHLVVLATEWQEFRDLDPEVAGGVVEKRAIIDGRNVLDVAKWKAAGWEMEALGRNL

SEQ ID NO: 263 - DNA, 1224 bp, Corynebacterium glutamicum
  CDS (101)..(1201): RXA02485
cggtggtcagtgcttggtgcaccttgccgacgggctgattgatcgtaatggtgttttctgtacgcgttgccatgaggataagactaccgttagtggggtgttggattcatcgctagcccaggaaatcgccgcgatcgacggcgtcgaactcgattcggaagtcactttcgccgatctgacgaccctccgcatcggcggaaaaccccgcagcgccgtacgttgccagaccacggaggcgctggtcagcgccataaaattgcttgacgacgcctccctccccctcctcattgtcggcggcgggtccaatctcgtcgtggccgacggcgatctggatgttattgccgtcatcatcgaaaccgacgacgtctccatcaacctcaccgacggtctcctcaccgccgatgcaggcgctgtttgggacgatgttgtccacctttcggtggatgccggcctcggtggaattgaatgcctctccggaatccccggctccgccggcgccaccccagtccaaaacgtgggcgcctacggcacggaagtttccgatgtactcacccgcgtccagcttctcgaccgcaccacccaccaagtctcctgggtcgacgcctccgaactcgacctctcttaccgatactccaatctcaaattcaccaaccgcgcagtcgtcttggcgatcgaactccagctcctcaccgacggattgtccgcgccgctacgttttggtgaattgggacgtcgattagcgatctccgaggccgaaccccacccacgtcgccccgtccgcatggtccgcgacgccgtcctagaactccgccgcgccaaaggcatggtcgtggaacacaccgaccacgacacctggtccgccggatccttcttcaccaacccaatcgtcgacccagcccttgccgacgcagtctttgaaaaagtcggcgaacccaccatgccccgcttcccagccggcgatggcaaagaaaaactctccgcagcctggctcatcgaacgcgccggcttcaaaaagggacaccccggcgcaggcgcaaaagcctccctgagcaccaaacacaccctcgcactcaccaaccgtggcgacgcccgcgcctccgacctcgtcgcattagccaaagaaatccgcgacggagtcctcgaaaccttcggcgtcaccctcgtcccagaacccgtctggattggaatcagcatcgatgactgaattttccgacgtccctggca

SEQ ID NO: 264 - protein, 367 aa, Corynebacterium glutamicum
LDSSLAQEIAAIDGVELDSEVTFADLTTLRIGGKPRSAVRCQTTEALVSAIKLLDDASLPLLIVGGGSNLVVADGDLDVIAVIIETDDVSINLTDGLLTADAGAVWDDVVHLSVDAGLGGIECLSGIPGSAGATPVQNVGAYGTEVSDVLTRVQLLDRTTHQVSWVDASELDLSYRYSNLKFTNRAVVLAIELQLLTDGLSAPLRFGELGRRLAISEAEPHPRRPVRMVRDAVLELRRAKGMVVEHTDHDTWSAGSFFTNPIVDPALADAVFEKVGEPTMPRFPAGDGKEKLSAAWLIERAGFKKGHPGAGAKASLSTKHTLALTNRGDARASDLVALAKEIRDGVLETFGVTLVPEPVWIGISIDD

SEQ ID NO: 265 - DNA, 1124 bp, Corynebacterium glutamicum
  CDS (1)..(1101): RXA01216
accgaccacactctgtctgcactgctggatgcacacgtggaagttccaaccgctgtcaccgtgttgaccatgcgtctggatgaccccaccggctacggccgcatcgtgcgcaacgaagaaggcgaagtcaccgccatcgttgagcaaaaagatgcttcagcagaagtccaagccatcgatgaggtcaactccggtgtctttgctttcgacgccgccatcttgcgttccgcactggctgaactgaagtccgacaacgctcagggcgagctgtacctgaccgacgttttgggcattgctcgtggcgagggccacccagtgcgcgcccacaccgccgccgatgctcgtgaactcgccggcgtcaacgatcgtgtgcagctcgcagaagccggcgccgaactaaaccgtcgcaccgtcatcgccgctatgcgtggtggcgcaaccatcgttgatccagcaaccacctggatcgatgtggaggtttctatcggacgcgacgtgatcatccaccctggcacccagctcaagggcgaaactgtcatcggagaccgcgttgaagttggtccagacaccaccttgaccaacatgaccatcggcgacggcgcatccgtaatccgcacccacggtttcgactccaccatcggtgaaaacgccaccgttggccccttcacctacatccgcccaggaaccacactgggaccagaaggcaagctcggtggcttcgtagaaaccaagaaggccacaatcggccgtggctccaaggttccacacctcacctatgtcggcgacgccaccatcggcgaggaatccaacatcggagcctcctctgtcttcgtgaactacgacggtgaaaacaagcaccacaccaccatcggcagccacgttcgcactggttctgacaccatgtttatcgctccagtgaccgtgggtgacggagcgtattccggagccggtacagtaattaaagacgatgttccgccaggagcccttgccgtgtccggcggacgccaacgaaacatcgaaggctgggtgcaaaagaagcgccctggaaccgctgcagcacaagccgcagaagccgcccaaaacgtccacaaccaggaaggctaagcaggatcctcatgactgct

SEQ ID NO: 266 - protein, 367 aa, Corynebacterium glutamicum
TDHTLSALLDAHVEVPTAVTVLTMRLDDPTGYGRIVRNEEGEVTAIVEQKDASAEVQAIDEVNSGVFAFDAAILRSALAELKSDNAQGELYLTDVLGIARGEGHPVRAHTAADARELAGVNDRVQLAEAGAELNRRTVIAAMRGGATIVDPATTWIDVEVSIGRDVIIHPGTQLKGETVIGDRVEVGPDTTLTNMTIGDGASVIRTHGFDSTIGENATVGPFTYIRPGTTLGPEGKLGGFVETKKATIGRGSKVPHLTYVGDATIGEESNIGASSVFVNYDGENKHHTTIGSHVRTGSDTMFIAPVTVGDGAYSGAGTVIKDDVPPGALAVSGGRQRNIEGWVQKKRPGTAAAQAAEAAQNVHNQEG

SEQ ID NO: 267 - DNA, 981 bp, Corynebacterium glutamicum
  CDS (101)..(958): RXA01259
aagagaattatttctaaaattcggtatcgtctaagaaatgagtttgccaatagctcagcatcaaaatgctgtaaaaactgtcgtggtaccagctgcaggaatgggaacacggttccttcctgcaacgaagacaattccaaaggagcttcttcctgtagttgataccccgggtattgaacttgttgccaaagaggctgctgatcttggtgcaactcggttagcaattatcactgctccgaacaaagacggaattcttaaacacttcgaggagttccctgagcttgaggcaactcttgaggctcgcggtaagactgatcaactgaataaagttcgagcagctcgagaattgattgcaacagttccagtggttcaagaaaagccattggggcttggtcacgctgttggccttgctgagtctgtgctcgatgatgatgaagatgttgtggctgtcatgctgccagacgatttggtgctgccatttggtgtgaccgagagaatggcagaagttcgcgctaagtttggcggatctgttcttgcagcaattgaggtggctgaagatgaagtctcaaattacggagtatttaagctcggtgaactcgatgcagagtccgaaagtgaaggcattaggcgtgttgtaggaatggttgaaaagcctgcgcctgaagatgcaccatcaaggtttgccgcaacgggccgttatctacttgatcgagctatttttgatgcactgcgtcgaattgagcctggtgctggtggagaactgcaattaacagatgccatcgcattattgatcgaagaaggccatccggtacacattgtggttcatgaaggaaagcgccatgaccttggtaatccagctgggtacattcctgctgttgtgtacttcggacttcgtcatgcagagtacggttccaagattcaccgtgcggtgaaggaaatactcgctgagtttgaatcttaaaaaggaaaccgccttccaca

SEQ ID NO: 268 - protein, 286 aa, Corynebacterium glutamicum
MGTRFLPATKTIPKELLPVVDTPGIELVAKEAADLGATRLAIITAPNKDGILKHFEEFPELEATLEARGKTDQLNKVRAARELIATVPVVQEKPLGLGHAVGLAESVLDDDEDVVAVMLPDDLVLPFGVTERMAEVRAKFGGSVLAAIEVAEDEVSNYGVFKLGELDAESESEGIRRVVGMVEKPAPEDAPSRFAATGRYLLDRAIFDALRRIEPGAGGELQLTDAIALLIEEGHPVHIVVHEGKRHDLGNPAGYIPAVVYFGLRHAEYGSKIHRAVKEILAEFES

SEQ ID NO: 269 - DNA, 526 bp, Corynebacterium glutamicum
  CDS (101)..(526): RXA02028
tgcgcagttcctgcttagtttggctcataaatctaaggataaccgttattttcggaggggtacgacgattggggttgcgggggcaggtactcttggttccatgagtttgcctatcgatgagcacgtgaacgcggttaaaaccgtcgtagtgcctgctgcaggactgggaacccgattccttccggccaccaaaaccgtacccaaggagttgctgccggttgtcgataccccaggtattgagctgattgctgctgaggctgccgaacttggtgcgaccaggctggcgatcatcactgcgccaaacaaagctggggtacttgcacactttgagcgttcttctgaattggaagaaacgctgatggagcgtggcaagactgaccaggtggagataatccgccgcgccgccgatttaatcaaggcagttccagtaacccaggacaagccgctggggctaggtcatgctgttggtttggctgagtctgtgttggatgatgatgaagatgtcgtagcggtgatgttgccgcac

SEQ ID NO: 270 - protein, 142 aa, Corynebacterium glutamicum
MSLPIDEHVNAVKTVVVPAAGLGTRFLPATKTVPKELLPVVDTPGIELIAAEAAELGATRLAIITAPNKAGVLAHFERSSELEETLMERGKTDQVEIIRRAADLIKAVPVTQDKPLGLGHAVGLAESVLDDDEDVVAVMLPH

SEQ ID NO: 271 - DNA, 1284 bp, Corynebacterium glutamicum
  CDS (101)..(1261): RXA01262
tatactcgtcaagggccttcgataaaacaaagacaattttcccccgacgggacaatctgaaaacttgctgtatcaataaaacacgaaaaggaatacttttatgaaaattgccgtcgcagggctcggatatgttgggctttcaaatgcagctctcctctctaaaaatcataaagttgttgcagttgacattgatgaagaacgagtgaaactagttcaagaatttcgttcgccaattgtcgatagcgatctcgaagaatatctgtccactaagcctcaaaacttaactgccacaacggacgccgaagccgcttacaaaggcgcagattttattgttattgcaacgccaactaattacgacccagagtcaaacttttttgatacttccagcgttgagtccgtaattgagatagtccttaaggtttctcctggatccacaatcgtaattaaatcgactatccctgttggttttacatcggaactacgcattaagcatccagaagcttcgattattttttcacctgagttcctgcgtgaaggccgagcattctacgacaatctctacccatccagagttgtcgttggtgatcgcagtcctctgggggaagaatttgcgactctgttagctgagggggcaaaagaaaagcctccgattctacttacggactcaactgaggcagaggcgattaaattattttctaatacatatcttgcactgcgagttgcttttttcaacgaactggatacttatgcgtctgttcgaagcttggatactaagcagattattgaaggggtagggctcgatccacgtattggatctcattacaataatccttcatttggatatggcggatattgtcttccgaaagatacgaaacagcttctcgccaactataaggatgtcccgcagaatctaatctctgcagtagtccaagcaaataagactcgtaaggactttattgcagaggatatcctcagtaaatcacctactgtagttggaatttaccgccttgtaatgaagtctggatcagataactttcgttcttcttctattcaaggagtcatgaaacgaattaaggccaagggaatcgaaattgtagtatttgaaccgaatctcggagaagaaactttctacaattcgaagatccttaatgacatcgaagagtttaaggattactgcgacatcattattgcaaatcgtccaaccgatgagctttctgatgtaccagaaaaagtttatacacgtgatattttccagcgtgactaagtggaaagaatcttttgttg

SEQ ID NO: 272 - protein, 387 aa, Corynebacterium glutamicum
MKIAVAGLGYVGLSNAALLSKNHKVVAVDIDEERVKLVQEFRSPIVDSDLEEYLSTKPQNLTATTDAEAAYKGADFIVIATPTNYDPESNFFDTSSVESVIEIVLKVSPGSTIVIKSTIPVGFTSELRIKHPEASIIFSPEFLREGRAFYDNLYPSRVVVGDRSPLGEEFATLLAEGAKEKPPILLTDSTEAEAIKLFSNTYLALRVAFFNELDTYASVRSLDTKQIIEGVGLDPRIGSHYNNPSFGYGGYCLPKDTKQLLANYKDVPQNLISAVVQANKTRKDFIAEDILSKSPTVVGIYRLVMKSGSDNFRSSSIQGVMKRIKAKGIEIVVFEPNLGEETFYNSKILNDIEEFKDYCDIIIANRPTDELSDVPEKVYTRDIFQRD

SEQ ID NO: 273 - DNA, 1209 bp, Corynebacterium glutamicum
  CDS (101)..(1186): RXA01377
tgaaatggatttgctgcggccccggaattacccttttcgcggccgtcatcaaatttgtacccccttaaagacaccctaaacacgagtgaaataggaacacatgactttaactgacaacagcaaaaacgttgatgctgtcatcttggtcggtggcaaaggtacccgactgcgccccctgaccgtcaatactccaaagccaatgctgccaactgctggccacccattcttgacccaccttttggcccgcatcaaggccgcaggcatcacacacgtcgtgctgggaacgtcattcaaagctgaagtcttcgaggaatacttcggagatggctccgaaatgggcttggaaattgaatatgtcgtcgaggatcagcctttgggcactggtggtggcatccgaaacgtctacgacaagctgcgtcacgatactgcgattgtgttcaacggcgatgtgctctccggtgcggatctcaacagcattctggacacccaccgcgaaaaggacgcagatctgaccatgcatctcgtgcgcgtagctaaccctcgtgcgtttggttgcgtccccaccgatgaggatggtcgcgtcagcgaattccttgaaaagaccgaagatccaccaaccgatcagatcaacgccggctgctacgtgttcaagaaggaactcatcgagcagatcccggcaggccgagcagtttccgtcgagcgcgaaaccttccctcagctgttggaagaaggcaagcgagtcttcggccacgtcgacgcttcctactggcgcgacatgggcaccccaagcgacttcgtccgcggctcggctgacctggtccgcggcattgcgtactccccattgctcgaaggcaaaacaggagagtcgcttgtcgacgcctccgccggcgttcgcgacggcgtcctgctgctcggcggaaccgtagtcggccgcggcactgagatcggtgccggctgccgcgttgacaacactgttattttcgacggcgtcaccattgaaccaggtgcggtcattgaaaattccatcatttcctcgggagcacgcatcggtgctaatgcgcacatctccggttgcatcattggcgagggcgcacaggttggtgctcggtgtgaactcaacgcagggatgcgcgtcttcccaggcgttgtgatcccagacagcggaattcgtttttcgtctgatcagtaggcatttttagcccttttgga

SEQ ID NO: 274 - protein, 362 aa, Corynebacterium glutamicum
MTLTDNSKNVDAVILVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 275 - DNA, 1350 bp, Corynebacterium glutamicum
  CDS (101)..(1327): RXA02063
accgaaatgggggcattaaaaggggctatcattcggaccccaaaacgatgtttagacaatttgttacccagctttcatgcgggatagttattttgcctttatggttaagggtgtgaagggtagaccaaatgttctagcaatcgttctcgcaggtggcgagggcaaacgactttttccgttgacggaggaccgagctaagcctgcggtcccattcggcggaacttacagattgatcgactttgttttgtcgaacctggtgaactccggattcctcaagatcgcggtactgactcagtacaagtcgcattcattggataggcatatttcattgtcgtggaacgtgtctggtccaacggggcagtacattgcttctgttcctgcgcagcagcgcctgggcaagcgatggttcactggttccgcggatgcaattttgcagtctctgaacttgatctctgatgagaaaccggattatgtcatcgttttcggcgcggaccacgtgtatcgcatggacccaagccagatgctagatgagcacattgcatctggtcgcgcggtgtctgtggcaggtattcgcgttccacgtgaggaagcaactgcgtttggttgcatccagtccgatgtcgacggcaacataaccgagttcttggaaaagccagctgaccctccgggaacccctgatgatcctgacatgacttacgcgtcgatgggtaactacattttcaccactgaagccctgatccaggcgctgaaagatgatgaaaataacgagaacagtgatcatgacatgggcggagacatcattccgtacttcgtctctcgcaatgatgcgcatgtttatgatttctccggaaacattgttcctggcgcaactgagcgtgacaagggctactggcgcgacgtcggtaccattgatgcgttctacgagtgccacatggacctgatttccgtgcacccaatcttcaatctgtataactctgagtggccaatccacacgacctctgaaggtaacttgcctccggctaagttcgttcggggcggtatcgcgcagtcgtcgatggtgtcttcaggttccatcatttctgctgggactgttcgcaactccgtgctgtccaacaacgttgtcgtcgaagagggcgcaacggtggaaggtgcagtgctgatgccaggcgtgcgcatcggtaagggtgctgttgtccgccatgcgattctggacaagaacgtggttgtccgcgacggagagctcatcggtgtcgaccaagtgcgcgatgcgcagcgcttcaaggtgagcgccggcggcgtcgtggttgtcggtaagaaccaggtagtctaaacgggaaagggaccttaaaa

SEQ ID NO: 276 - protein, 409 aa, Corynebacterium glutamicum
MVKGVKGRPNVLAIVLAGGEGKRLFPLTEDRAKPAVPFGGTYRLIDFVLSNLVNSGFLKIAVLTQYKSHSLDRHISLSWNVSGPTGQYIASVPAQQRLGKRWFTGSADAILQSLNLISDEKPDYVIVFGADHVYRMDPSQMLDEHIASGRAVSVAGIRVPREEATAFGCIQSDVDGNITEFLEKPADPPGTPDDPDMTYASMGNYIFTTEALIQALKDDENNENSDHDMGGDIIPYFVSRNDAHVYDFSGNIVPGATERDKGYWRDVGTIDAFYECHMDLISVHPIFNLYNSEWPIHTTSEGNLPPAKFVRGGIAQSSMVSSGSIISAGTVRNSVLSNNVVVEEGATVEGAVLMPGVRIGKGAVVRHAILDKNVVVRDGELIGVDQVRDAQRFKVSAGGVVVVGKNQVV

SEQ ID NO: 277 - DNA, 903 bp, Corynebacterium glutamicum
  CDS (101)..(880): RXN00014
catcaaagtgaccgccggcggcgtcgaatggtccgttgcaggaaacgcggaagcagttagtgagatctccgaaactttaagcgcactagactaacaacacatgagcaaatatgcagacgatttagccttagccctcgaacttgccgaacttgccgattccatcaccctcgaccgcttcgaagcctctgacctggaagtatcctccaagccagacatgactcccgtcagcgatgccgacctggcgaccgaagaagcactccgtgagaaaatcgccaccgcccgccccgccgactccatcctcggtgaagaattcggtggcgacgtagaattcagcggccgccagtggatcatcgaccccatcgacggcaccaaaaactacgtccgcggcgtccccgtatgggcaaccctgatcgcgctgctcgacaacggcaaacccgtcgcaggtgtcatctccgcacccgcactggctaggcgttggtgggcatccgaaggggccggcgcatggcgcaccttcaacggcagctccccacgcaaactgtccgtgtcccaggtgtccaagcttgacgacgcctccctctccttctcctccctctccggctgggccgaacgagatttgcgcgatcagttcgtctccctaactgataccacctggcgactccgcggctacggcgacttcttctcctactgcctcgtcgccgaaggtgccgtcgatatcgccgctgaaccagaagtcagcctctgggatcttgctcccctgtccatcctggtcaccgaagccggaggaaagttcacctcactggctggcgtcgatggaccacacggtggcgatgcagtagccaccaacggcatcctgcacgatgagacgctggatcgtttaaaatagactcccgggttttgcttggt

SEQ ID NO: 278 - protein, 260 aa, Corynebacterium glutamicum
MSKYADDLALALELAELADSITLDRFEASDLEVSSKPDMTPVSDADLATEEALREKIATARPADSILGEEFGGDVEFSGRQWIIDPIDGTKNYVRGVPVWATLIALLDNGKPVAGVISAPALARRWWASEGAGAWRTFNGSSPRKLSVSQVSKLDDASLSFSSLSGWAERDLRDQFVSLTDTTWRLRGYGDFFSYCLVAEGAVDIAAEPEVSLWDLAPLSILVTEAGGKFTSLAGVDGPHGGDAVATNGILHDETLDRLK

SEQ ID NO: 279 - DNA, 903 bp, Corynebacterium glutamicum
  CDS (101)..(880): FRXA00014
catcaaagtgaccgccggcggcgtcgaatggtccgttgcaggaaacgcggaagcagttagtgagatctccgaaactttaagcgcactagactagcaacacatgagcaaatatgcagacgatttagccttagccctcgaactcgccgaacttgccgattccatcaccctcgaccgcttcgaagcctctgacctggaagtatcctccaagccagacatgactcccgtcagcgatgccgacctggcgaccgaagaagcactccgcgagaaaatcgccaccgcccgccccgccgactccatcctcggtgaagaattcggtggcgacgtagaattcagcggccgccagtggatcatcgaccccatcgacggcaccaaaaactacgtccgcggcgtccccgtatgggcaaccctgatcgcgctgctcgacaacggcaaacccgtcgcaggtgtcatctccgcacccgcactggctaggcgttggtgggcatccgaaggggccggcgcatggcgcaccttcaacggcagctccccacgcaaactgtccgtgtcccaggtgtccaagcttgacgacgcctccctctccttctcctccctctccggctgggccgaacgagatttgcgcgatcagttcgtctccctaactgataccacctggcgactccgcggctacggcgacttcttctcctactgcctcgtcgccgaaggtgccgtcgatatcgccgctgaaccagaagtcagcctctgggatcttgctcccctgtccatcctggtcaccgaagccggaggaaagttcacctcactggctggcgtcgatggaccacacggtggcgatgcagtagccaccaacggcatcctgcacgatgagacgctggatcgtttaaaatagactcccgggttttgcttggt

SEQ ID NO: 280 - protein, 260 aa, Corynebacterium glutamicum; identical to SEQ ID NO: 278

SEQ ID NO: 281 - DNA, 978 bp, Corynebacterium glutamicum
  CDS (101)..(955): RXA01570
cactgaactccgttttggatctcggcaaaatcgaagccaccggatttagcgcaccgacctggcagacccgcctcaacgactacctcaaggaactctcaaagtgaaaggcatcatcctcgcaggtggctccggcacccggctctaccccatcaccaagggcatctccaagcaactgatgccgatttacgacaaacccatggtctactacccactgaccacgctcattcaggccggcatcaaagacatcctgattatcaccacccctgaagacagcgcctcctttgaacgcttgcttggcgacggctcctcctggggcatcaacctcacctacgccgtccaaccctcccccgacggactagcccaagcattcatcatcggcgaggaattcatcggtgacgacgacgtcgcgttggtgcttggcgataacatcttcgacggcgcacaacttggccacgcactaaagcagtgctccaaccccgacggtggcattgtctttgcttatgaggtctccgatcctgagcgttatggcgtggtggaatttgatgctgctaataaggcggtgtctattgaagaaaagcccaccgcgccaaaatccaactttgccgtggtaggactatatttctacgacaatcgcgtggtggacatcgccaagtcaatcaagccttcctcgcgtggcgaactggaaatcacctccgttaacgatgcctacctccagcaaggtgctttaactgtgcagcgcctggaccgtggcgatgtctggttagataccggcacaatcgattccatgtccgaggcgtcttcctatgttgaggtcctgcaaaaacgtaccggcaacatcatcggatcccccgaagtcgctgcgtaccgcgaaggtttcatcacagctgaagaactcacagtgcttggtgaggaactgaagaaatcaggctacggaaactacctgctgagagctttgtaatttacggtgtggttgtggag

SEQ ID NO: 282 - protein, 285 aa, Corynebacterium glutamicum
VKGIILAGGSGTRLYPITKGISKQLMPIYDKPMVYYPLTTLIQAGIKDILIITTPEDSASFERLLGDGSSWGINLTYAVQPSPDGLAQAFIIGEEFIGDDDVALVLGDNIFDGAQLGHALKQCSNPDGGIVFAYEVSDPERYGVVEFDAANKAVSIEEKPTAPKSNFAVVGLYFYDNRVVDIAKSIKPSSRGELEITSVNDAYLQQGALTVQRLDRGDVWLDTGTIDSMSEASSYVEVLQKRTGNIIGSPEVAAYREGFITAEELTVLGEELKKSGYGNYLLRAL

SEQ ID NO: 283 - DNA, 891 bp, Corynebacterium glutamicum
  CDS (101)..(868): RXA02666
gctcggcgacgaggaagagaagaaggacgcattcgacgacttcgacgattccgacgtggatcttgacgatctgagcttcgacgacgaagattagacgcccatgtcgtctacacgaatccccgtcatcgcactcctcgcggcggcggggcgcggaacccgcctcggcggacccatccccaaagcattcgtcacgttgcgtgaacgcacacttttagagcgctcgctccaagccatgctcacctccgaaagcgtcgacgaaatcatcatcctcgtcagccccgacatggaaacctacgcccgcgatttgctgcgcaaacgcggtcttttgaacgaccccgaaggggtacgcgtacggctcgtgcacggcggcggggagcgcgcggactcggtctgggcaggccttcaggcaatttcgcttgacgacgccacccccgatgcaattgtcttaatccacgacagcgcccgagcgctcacaccacccggcatgattgcgcgcgtggtgcgcaaagtccacgaaggcgccaccgcagtcatcccagtactgccagtatcggacaccatcaaacgagtgtcccctgatggcggagtagttgtcgacacacccaaccgtgcagaacttcgcgccgtccaaaccccacaaggcttcctgctgtccgaacttgttgcagcgaatgagaaattcttcgccgaccccaacccaggcttcatcccaaccgatgacgccagcttgatggaatggtacggcgcagatgtagtctgcgtacaaggcgacccaatggcgtttaaagtaacaacccccattgatatgatgctggcacaacgcatcaccgacgaagccgaacccacaatatttgaggtaccaggtgactaacccaatcatcccccgcgtag

SEQ ID NO: 284 - protein, 256 aa, Corynebacterium glutamicum
MSSTRIPVIALLAAAGRGTRLGGPIPKAFVTLRERTLLERSLQAMLTSESVDEIIILVSPDMETYARDLLRKRGLLNDPEGVRVRLVHGGGERADSVWAGLQAISLDDATPDAIVLIHDSARALTPPGMIARVVRKVHEGATAVIPVLPVSDTIKRVSPDGGVVVDTPNRAELRAVQTPQGFLLSELVAANEKFFADPNPGFIPTDDASLMEWYGADVVCVQGDPMAFKVTTPIDMMLAQRITDEAEPTIFEVPGD

SEQ ID NO: 285 - DNA, 1056 bp, Corynebacterium glutamicum
  CDS (101)..(1033): RXA00825
cccgttcatgctgggctttggtgcggtgatggcaactatttgtctgatcattgtgagttttagtgcacgccgattctgagaaacaactaaagtgagccacatgcgcacagtagttaccggcggtgccggcttcatcggatcccatctcgttgaccttttgatcaaggaaggccacgaggtcgttgtgatcgataacctctcccgcggacgcctggagaatctctccgatgcggaagccaccggaaaactcacctttgtggaagccgatcttctcgacgttgatttcaacgagtttctaggaacccacaagcctgaggttattttccacctggcagcgcaaatcgatgtgcgccactctgttgtagatcctcttcacgacgccgaaaccaacattttgtccaccatccgcatcgctgacgctgcccgccagcacggtgttcgcaaggttgtctttacctcctcaggcggttccatttacggtgagccttcggaattcccagttgatgaaaccgtgccagtggatccacattccccttatgcggcatccaaggtgtccggtgaaatttacctgaacaccttccgccacctgtacggcttagactgttctcacatcgcaccggcaaatgtttacggcccacgccaagatccacacggtgaagcaggagttgtggccattttcgcgctgcgacttctgggaggcctggacaccaaggtattcggcgacggcggaaacacccgcgactacgtctacgtcggtgacgtagttcgtgctttctacctggcttctggggaaatcggtgggggagagcgcttcaacattggcacctctgtggaaacctctgaccgccagctgcacaccctcgtggccactgcggcaggttccaaagatgatcctgaatatgcacctgcacgtctcggcgatgtgccacgcagtgcactcagcttcggcaaggccaaagaggtgcttggttgggagcctgaggtgaacatcgaacaaggtgtggccaagactgtggagtacttccgcactcactaggggaaaatccaccacaaatc

SEQ ID NO: 286 - protein, 311 aa, Corynebacterium glutamicum
MRTVVTGGAGFIGSHLVDLLIKEGHEVVVIDNLSRGRLENLSDAEATGKLTFVEADLLDVDFNEFLGTHKPEVIFHLAAQIDVRHSVVDPLHDAETNILSTIRIADAARQHGVRKVVFTSSGGSIYGEPSEFPVDETVPVDPHSPYAASKVSGEIYLNTFRHLYGLDCSHIAPANVYGPRQDPHGEAGVVAIFALRLLGGLDTKVFGDGGNTRDYVYVGDVVRAFYLASGEIGGGERFNIGTSVETSDRQLHTLVATAAGSKDDPEYAPARLGDVPRSALSFGKAKEVLGWEPEVNIEQGVAKTVEYFRTH

SEQ ID NO: 287 - DNA, 1134 bp, Corynebacterium glutamicum
  CDS (101)..(1111): RXA01887
catctttacaggaaaccccttgacggcatcaatgggtggtatctagtatctactagaacgttatagtagaacgttctagtaaaacttggaaggatgaaaaatgtcagtcaaacttgccctcatcggtgctggacgcatcggatcaaatcacgcacgcctgatcacaaaccacgtgatcggctctgaactggtcgccgtcgttgacccaactcccaacgcagaaaccctcgctgatgaattgggcgccgttgcgttctctaacccagatgacgtcctgacccgcgatgacattgacgcggttttgattgctacaccagcacgaacccacgcggatctcgtggtcaaagcagcggcagcgggcaagcacgtgtttgtggaaaagcccatggccgtcaccctcgaggacgcagatcgtgccatcaacgcagcacgcgaagcaaacactgtcctgcaggtgggcttcaatcgtcgtttcgcggcaggtttcgctgcagcacgcgcacgcattgacgcaggcgatatcggcaccccacagctgcttcgttccgtgacccgcgatccaggaccattcaccgctgaccccaacaagatccctcagtggaccatcttcctggaaaccctcatccacgatttcgatgcgctgtgctacctcaacccaggcgcaaccccagtggaagtaaccgctcacgctgattgcctcgtcgttccagaagctgctggcactggcttcctcgacaccgcagtggtgactgtccgttttgataacggagcaattggtactgcagaagcaagcttcagcgcagcctatggttatgacgttcgcggtgaagtcttcggatccaagggcatgatgaccgcaggcgacgcgcgcgcaaccaacatgactttctacggcgctgagggcatcgcggctgccacctcacgcgcggataccgatctgctctccgatgcttaccgagctgaattccaagctttcgtcgactccatccgtaccaacaccccttccaaggttccaggcgaagctgcacgcaccgcactactcatcgcactcggcgccatccgaagcgtagaaaccggcgcaaccatcaaccttgctgaaagcatcgaggtttaaccatgacttttaaactcgca

SEQ ID NO: 288 - protein, 337 aa, Corynebacterium glutamicum
MSVKLALIGAGRIGSNHARLITNHVIGSELVAVVDPTPNAETLADELGAVAFSNPDDVLTRDDIDAVLIATPARTHADLVVKAAAAGKHVFVEKPMAVTLEDADRAINAAREANTVLQVGFNRRFAAGFAAARARIDAGDIGTPQLLRSVTRDPGPFTADPNKIPQWTIFLETLIHDFDALCYLNPGATPVEVTAHADCLVVPEAAGTGFLDTAVVTVRFDNGAIGTAEASFSAAYGYDVRGEVFGSKGMMTAGDARATNMTFYGAEGIAAATSRADTDLLSDAYRAEFQAFVDSIRTNTPSKVPGEAARTALLIALGAIRSVETGATINLAESIEV

SEQ ID NO: 289 - DNA, 996 bp, Corynebacterium glutamicum
  CDS (101)..(973): RXN00013
ctgcagaaaattcgggacgcatgattgcacatattacccgcaccgattgtgattcttagaacgccaccttattcagcacacttggccgacggcatgcacaatggaaggcatgactaatccagagcagacacatcccgctgcaagcctcgaagacatgatcaaaaccatcacaaagaccttcgtgattgctcacgatcaggattctgatgagcatcttgcgcaggcactggtgtacaacgctggacgtttggcatggcgcatgcgcgaaaacggtgtggatacggattacaagacttctgtgtctgatgtggtcacggatgccgatcgtgcggccgaggccttcgtcgcaggcgttcttgaagcgttgcggcctgaggacggcgtgcttggcgaggaaggcgcggaccgggcgtcgaaaagcggaaaaacctgggtcatcgacccggttgatggcacctacaacttcacccagggctcagattattggtgctcggcgctcgcgctggtcgagggcgatccatccgcgccatcgcgcgtgcttttcggcgccgtacaccgcccagccatgggttatacgtggttcggtggcccgggaatccgcaccacgctcgacggcaaggagctagatttgcttgtcgacgcccccctcaatcaaatctccctggccacctacatccacccgtcacgcatcgcggaacctgatattcaaaaggcgtggatgagcgttgccacccaccctgcaacgctgcgcatgttcggcgccggctccatcgatttggccaacatcgccgacggcagcatgggcgcatgggtgcagcacagcgtcgcagattgggactggctacccggccgcgcactcatcgaaggcgtcggcggagcatgcatcaaagtgaccgccggcggcgtcgaatggtccgttgcaggaaacgcggaagcagttagtgagatctccgaaactttaagcgcactagactaacaacacatgagcaaatatgc

SEQ ID NO: 290 - protein, 291 aa, Corynebacterium glutamicum
MEGMTNPEQTHPAASLEDMIKTITKTFVIAHDQDSDEHLAQALVYNAGRLAWRMRENGVDTDYKTSVSDVVTDADRAAEAFVAGVLEALRPEDGVLGEEGADRASKSGKTWVIDPVDGTYNFTQGSDYWCSALALVEGDPSAPSRVLFGAVHRPAMGYTWFGGPGIRTTLDGKELDLLVDAPLNQISLATYIHPSRIAEPDIQKAWMSVATHPATLRMFGAGSIDLANIADGSMGAWVQHSVADWDWLPGRALIEGVGGACIKVTAGGVEWSVAGNAEAVSEISETLSALD

SEQ ID NO: 291 - DNA, 996 bp, Corynebacterium glutamicum
  CDS (101)..(973): FRXA00013
ctgcagaaaattcgggacgcatgattgcacatattacccgcaccgattgtgattcttagaacgccaccttattcagcacacttggccgacggcatgcacaatggaaggcatgactaatccagagcagacacatcccgctgcaagcctcgaagacatgatcaaaaccatcacaaagaccttcgtgattgctcacgatcaggattctgatgagcatcttgcgcaggcactggtgtacaacgctggacgtttggcatggcgcatgcgcgaaaacggtgtggatacggattacaagacttctgtgtctgatgtggtcacggatgccgatcgtgcggccgaggccttcgtcgcaggcgttcttgaagcgttgcggcctgaggacggcgtgcttggcgaggaaggcgcggaccgggcgtcgaaaagcggaaaaacctgggtcatcgacccggttgatggcacctacaacttcacccagggctcagattattggtgctcggcgctcgcgctggtcgagggcgatccatccgcgccatcgcgcgtgcttttcggcgccgtacaccgcccagccatgggttatacgtggttcggtggcccgggaatccgcaccacgctcgacggcaaggagctagatttgcttgtcgacgcccccctcaatcaaatctccctggccacctacatccacccgtcacgcatcgcggaacctgatattcaaaaggcgtggatgagcgttgccacccaccctgcaacgctgcgcatgttcggcgccggctccatcgatttggccaacatcgccgacggcagcatgggcgcatgggtgcagcacagcgtcgcagattgggactggctacccggccgcgcactcatcgaaggcgtcggcggagcgtgcatcaaagtgaccgccggcggcgtcgaatggtccgttgcaggaaacgcggaagcagttagtgagatctccgaaactttaagcgcactagactagcaacacatgagcaaatatgc

SEQ ID NO: 292 - protein, 291 aa, Corynebacterium glutamicum; identical to SEQ ID NO: 290

SEQ ID NO: 293 - DNA, 948 bp, Corynebacterium glutamicum
  CDS (101)..(925): RXA01099
ggatgagggcattgattccgtcatcattggcaaggcactttatgagcacaagttcaccctcgaagaggctttggctgcagtagaaaagctcggttaatacatggatgctcgtgggatgttggccattgcggaggccgttgtagatgatgccgaagccctcttcatgcagggcttcggagctgcacctgcccatatgaaatccccgggggattttgccacggaagtggatatggccatcgaatcccatatgcgttcgatgctgaacatgatgacaggcattgctgtcatcggtgaagaaggtggcggtgcgacctccggcacgcgctgggtgattgatcccatcgacggcaccgccaacttcgcggcgtccaacccgatgagcgcgatcctggtgtctttgcttgtcgacgaccagcccgtcctgggtattacctccatgcccatgctgggtaaacgcctcaccgcttttgaaggttcaccgctgatgatcaacggtgaacctcaggaaccattgcaagaacaatccagtttggtatcccacattggttttagttccatggcctccccgcgcaatacagcgtttcctgtggagttgcgtcgggatcttctgaccgagctcacggaatcgtatcttcgtccccgcattacaggttcggtgggtgttgatctcgcgttcactgcgcagggcatttttggagcatgcgtatcgtttagtcctcatgtttgggacaattccgcaggcgtgatgttgatgcgcgctgctggtgcacaagttactgacaccgaaggccatccgtgggcaccaggtaggggagtcgtggccggaacaaaaagggctcacgatgtgctgttaagtaagattgaaaaagttcggttgatgcatgcagatgcaggtaatgaccagtcgttaaatgaggagtacaagtaaaatgggcgtggcaattcgag

SEQ ID NO: 294 - protein, 275 aa, Corynebacterium glutamicum
MDARGMLAIAEAVVDDAEALFMQGFGAAPAHMKSPGDFATEVDMAIESHMRSMLNMMTGIAVIGEEGGGATSGTRWVIDPIDGTANFAASNPMSAILVSLLVDDQPVLGITSMPMLGKRLTAFEGSPLMINGEPQEPLQEQSSLVSHIGFSSMASPRNTAFPVELRRDLLTELTESYLRPRITGSVGVDLAFTAQGIFGACVSFSPHVWDNSAGVMLMRAAGAQVTDTEGHPWAPGRGVVAGTKRAHDVLLSKIEKVRLMHADAGNDQSLNEEYK

SEQ ID NO: 295 - DNA, 576 bp, Corynebacterium glutamicum
  CDS (1)..(576): RXN01332
cacatctctgccattattgagcccgacgcagcacgtgccgctgcagctgcagaagacgcgccgggtgcacaggccttcactcgcattgaagatgctatcgcagccgatgctgtcgacgcagtgctgatcgccgtaccaggtcagttccatgagccagtacttgtcccagcactagaagcaggccttcccatcctgtgtgaaaagccactgaccccagattctgaatcctcactgcgcatcgtcgagctggagcagaagctggacaagccacacatccaggttggtttcatgcgccgcttcgaccctgagtacaacaacttgcgcaaattggtggaatccggcgaagctggcgaactgctcatgctccgcggcctgcaccgcaacccaagtgttggtgagagctacacccagtccatgctgatcaccgactccgtcgtccacgaattcgatgtcatcccatggctcgcaggctcccgagttgtctccgttgaagtgaagtacccaaagacctcctcactggcgcactccggcctcaaggaaccaatcctggtgatcatggagctcgaaaacggcgtg

SEQ ID NO: 296 - protein, 192 aa, Corynebacterium glutamicum
HISAIIEPDAARAAAAAEDAPGAQAFTRIEDAIAADAVDAVLIAVPGQFHEPVLVPALEAGLPILCEKPLTPDSESSLRIVELEQKLDKPHIQVGFMRRFDPEYNNLRKLVESGEAGELLMLRGLHRNPSVGESYTQSMLITDSVVHEFDVIPWLAGSRVVSVEVKYPKTSSLAHSGLKEPILVIMELENGV

SEQ ID NO: 297 - DNA, 549 bp, Corynebacterium glutamicum
  CDS (1)..(549): FRXA01332
gcagcacgtgccgctgcagctgcagaagacgcgccgggtgcacaggccttcactcgcattgaagatgctatcgcagccgatgctgtcgacgcagtgctgatcgccgtaccaggtcagttccatgagccagtacttgtcccagcactagaagcaggccttcccatcctgtgtgaaaagccactgaccccagattctgaatcctcactgcgcatcgtcgagctggagcagaagctggacaagccacacatccaggttggtttcatgcgccgcttcgaccctgagtacaacaacttgcgcaaattggtggaatccggcgaagctggcgaactgctcatgctccgcggcctgcaccgcaacccaagtgttggtgagagctacacccagtccatgctgatcaccgactccgtcgtccacgaattcgatgtcatcccatggctcgcaggctcccgagttgtctccgttgaagtgaagtacccaaagacctcctcactggcgcactccggcctcaaggaaccaatcctggtgatcatggagctcgaaaacggcgtg

SEQ ID NO: 298 - protein, 183 aa, Corynebacterium glutamicum
AARAAAAAEDAPGAQAFTRIEDAIAADAVDAVLIAVPGQFHEPVLVPALEAGLPILCEKPLTPDSESSLRIVELEQKLDKPHIQVGFMRRFDPEYNNLRKLVESGEAGELLMLRGLHRNPSVGESYTQSMLITDSVVHEFDVIPWLAGSRVVSVEVKYPKTSSLAHSGLKEPILVIMELENGV

SEQ ID NO: 299 - DNA, 1128 bp, Corynebacterium glutamicum
  CDS (101)..(1105): RXA01632
aagggctgcaacgtgctttcgacaccaccatcgcagcgtttgaacaagctgctcgtctcgccccctccactaactgatctttgaaaggctgaaaaaactcatgactcttcgtatcgcccttttcggcgctggccgcatcggtcacgtccacgctgccaacattgctgcaaaccctgatcttgaactcgttgttatcgccgatcctttcattgaaggcgcacagcgtttggcagaagccaatggggcagaagcggttgcatcaccagatgaggtgttcgcccgcgatgatatcgatggcatcgtgatcggttcaccaaccagcacccacgttgatctgatcacccgcgccgtggaacgtggcattcctgcactgtgcgaaaaacccattgatttagacattgaaatggtgcgtgcctgcaaagagaagatcggcgacggcgcttccaaggtgatgctggggtttaaccgacgcttcgatccttctttcgctgccatcaatgcgcgagtggcaaaccaggagatcggcaacctggagcagttggtgatcatcagccgcgatccagcgcccgcaccgaaggactacatcgcaggttccggtggaatcttccgcgatatgaccatccacgatctggatatggcgcgtttctttgtgcccaatatcgtggaagtgactgcaaccggcgccaatgttttcagccaggaaatcgcggagttcaatgactacgaccaggttatcgtcacgcttcgtggctcaaagggcgagttgatcaacatcgtgaactcccgccactgctcctacggctacgaccagcgacttgaggctttcggctctaagggcatgctcgccgccgacaacatcaggcccaccacggtgcgcaagcacaatgcggaaagcaccgagcaggcagatccgattttcaacttcttcctcgagcgctacgacgccgcttacaaggcagagctcgcaacttttgctcaaggaatccgcgacggccaaggcttctcaccaaacttcgaggacggcgtcatcgcccttgaactagcgaatgcatgccttgaatcagctcaaaccggccgcaccgtcaccctcaaccctgccaacgtttagtcaacgtctagttaatgcct

SEQ ID NO: 300 - protein, 335 aa, Corynebacterium glutamicum
MTLRIALFGAGRIGHVHAANIAANPDLELVVIADPFIEGAQRLAEANGAEAVASPDEVFARDDIDGIVIGSPTSTHVDLITRAVERGIPALCEKPIDLDIEMVRACKEKIGDGASKVMLGFNRRFDPSFAAINARVANQEIGNLEQLVIISRDPAPAPKDYIAGSGGIFRDMTIHDLDMARFFVPNIVEVTATGANVFSQEIAEFNDYDQVIVTLRGSKGELINIVNSRHCSYGYDQRLEAFGSKGMLAADNIRPTTVRKHNAESTEQADPIFNFFLERYDAAYKAELATFAQGIRDGQGFSPNFEDGVIALELANACLESAQTGRTVTLNPANV

SEQ ID NO: 301 - DNA, 1206 bp, Corynebacterium glutamicum
  CDS (101)..(1183): RXA01633
gcgaatgcatgccttgaatcagctcaaaccggccgcaccgtcaccctcaaccctgccaacgtttagtcaacgtctagttaatgcctaaggagaaaacctcatgaaaaacatcaccatcggaatggtcggcgtcggccgcattggccgcatgcacgtcgccaacatgcttgccgttgctgaaactttgaaggaacgcgacctcaacattgagatcgtgctcgcagacgcaatgcccggttttgcggagcaggtgggcgcggacatgggcgtgaaggcggcggcaagcgtcgataagcttattgaggacggggtggatgcccttttcattgccaccagcaccgctggccacgtcgatgttttgcgcaagggcatcgcggcaaagctgccgatgttctgcgagaagccgatcgcgtcggatgtgcctgagtcgctgaacatcatccgcgaaattgatgcggctggcgcgacggttcaggtcggccaccagcgccgttttgacctcggttaccaggaagctaaacgacgcctagatgcaggcgacctcggctggcttcattcgctcaaggccgtatcgagcgatgcgtttccgccaccggtgtcctactgcgctacctctggtggacttttccgcgatgtgtcgctgcacgatttcgacatcattcgctggctgaccggccaggatattgtcgaggtgtacgccaagggcagcaacaacggcgacccagaaatcggcgcagtcggtgacatcgataccggagcggccctactcacgcttgccgacggcaccctcgccaccgccatcgccactcgttacaacggtgcaggccacgacgttcgcctcgatgttatgggctctaaagattccacgatcgttggcctggatgaaaagtctgcgttcgcttctgcggaggagggcatcgatttcccaaccggcgaatcgcacccaacgtttgccgagcgcttcgccgacgcatacaagaatgagtgcattgcgttcgtggagttgatcctgggagagcgggaaaacccttgtacccctgcagacgctgtggctgcggcgattgttgccgatgcagctcagctgtcgctggtcactggcgagccagtgaagattcctactgtacgggaaattcttgaaggttctgcgcagccagttgaggtgcgtgcgctggttccatctgcttaaaaccttactgcttatctaaa

SEQ ID NO: 302 - protein, 361 aa, Corynebacterium glutamicum
MKNITIGMVGVGRIGRMHVANMLAVAETLKERDLNIEIVLADAMPGFAEQVGADMGVKAAASVDKLIEDGVDALFIATSTAGHVDVLRKGIAAKLPMFCEKPIASDVPESLNIIREIDAAGATVQVGHQRRFDLGYQEAKRRLDAGDLGWLHSLKAVSSDAFPPPVSYCATSGGLFRDVSLHDFDIIRWLTGQDIVEVYAKGSNNGDPEIGAVGDIDTGAALLTLADGTLATAIATRYNGAGHDVRLDVMGSKDSTIVGLDEKSAFASAEEGIDFPTGESHPTFAERFADAYKNECIAFVELILGERENPCTPADAVAAAIVADAAQLSLVTGEPVKIPTVREILEGSAQPVEVRALVPSA

SEQ ID NO: 303 - DNA, 1146 bp, Corynebacterium glutamicum
  CDS (101)..(1123): RXN01406
gttcctcattcctctaatcggcgcactatctttgcctcgcgacggcggtgcccgagccttttcctcctcttagaaacccacttctgaaaggtataaaaacatgactattcgaatcggactcgttggctacggtgtcggcggcaggctctttcacaccccttacatccaagcttctacgcactgcgaattagtaggcgtagttgctcgttccgaaggcaccaaagcagccgttgcagaagatcttccagatgttgccatcgtgggatcgctgacagaactcctcgaactgggcgtcgatgcagtggtgatctccacccctccagccacgcgccgggaactggccttggaagcaatcaacgcaggtgtcgcagtggttgccgataaaccgtttgcaccatcagccgcagatgccatggaacttgtcgaagccgccgaaaaggctggagtgctgctcaacgtcttccacaacaggcgcaacgacacccacattgtcacggcactgggaatccaagaagaacttggtgcgatgcgtggactggacctgcgactagacctgatcgaacctgattccttggaggcaggtcctgaaggtggtttgctgcgcgatctgggctcacacgtagtcgatcagaccctggttctcatggggccggctacctctgtcaccgcccaacttggatccatcgaccttccagaaggcccaaccaacgcaaggttccgcatcgtgttggaacatgaatcgggcgccgtatcgcacatttctgccagcaagattgaccgcttggagtcctgggaaatccgcttggtgggcgagcgcggctcctacgtatccaactacaccgacgtgcagaccgtggcgatcaaacagggacttcgaccaaccaatgaccgcgaacactggggctacgaatcggaggagcggtggggcaccttggttaccgatgaaggctcaaaggtgattccttcagcacaaggcgattacacccgcttctacgatgcctttgccttggctgtggaaaacggtggcgcagggccggtgcctgcacgtgaaggtgttgcagtgctcaaggtgttggatgctgtagcccagagcgctgcggaaaaacgcaccattgagttgagctaaggagaagtgctgctggctgc

SEQ ID NO: 304 - protein, 341 aa, Corynebacterium glutamicum
MTIRIGLVGYGVGGRLFHTPYIQASTHCELVGVVARSEGTKAAVAEDLPDVAIVGSLTELLELGVDAVVISTPPATRRELALEAINAGVAVVADKPFAPSAADAMELVEAAEKAGVLLNVFHNRRNDTHIVTALGIQEELGAMRGLDLRLDLIEPDSLEAGPEGGLLRDLGSHVVDQTLVLMGPATSVTAQLGSIDLPEGPTNARFRIVLEHESGAVSHISASKIDRLESWEIRLVGERGSYVSNYTDVQTVAIKQGLRPTNDREHWGYESEERWGTLVTDEGSKVIPSAQGDYTRFYDAFALAVENGGAGPVPAREGVAVLKVLDAVAQSAAEKRTIELS

SEQ ID NO: 305 - DNA, 1200 bp, Corynebacterium glutamicum
  CDS (101)..(1177): RXN01630
gtaggtgagtcttcgtgagatacccccggccagtcatacagttcaaccaagctccaccacccagataaaaacctgcgggttgcgttttaggagaattcccatgagtgatcaaaaaattgttgttggcctgctaggcatcacccacccgcatgcgtcggcgcgggtgcgtgccctccgtgaaattgatggggtagaggtcgtcgccgccgcggatactgattcccgcctccagtacttcaccgacaaatatgatgttgaaccccgcgagatcgatgacgtcttgaacgacgatcgcatcaacgccatcatggttcactccaagagcaaggacatggtccctcacgccaagcgcgcgctcgcggccggaaaatccgtcgtcgtggagaagcccggcgggggaacagtggcggatcttgaggagctcctggccctcaaagaagctgccgatcctcagcgaatcgtgcaggtcgggtacaacgtccgcctgtctgaatcggttcagagattaaaagagcttctcgacgccggcctcatcggcgaagtcgtcagcgtgcaagcacgcggcgccgcaaaagtaggtgagcatatcaccgagcacctcaaccaacccgcagacatgggcggtgtgttgtggattcttggctgccacatgctcgatgcattggtggaagtcttcggagctccagaatccgtgaacgcccgagtgcataagaccgcaaaactctctgacgacaccagccgcgaagactcagcctccgcactgctgtactacccagatttctccgtcagcttcagcttcgacggccacgatgatctggaatggttcgaaagctcccgactcacggtctatggaaccaagggcatgatcgaagccggaatcctccctcagacactgcgcgtatacctcaatgagtcacgccagggctggccacagggttggaccgagtggacccagagctacttcaccccaccgtttgctcgcacagaatccaacaaattctcagagcttccagagctagaaaacatcagcaacttccgcacagaaatgcaggggtgggtgaattccattcgcactggatcccgcaatgtggcgccagttgaggatgctctcacagtcgctcgcattgtcagtgcatgctacgaatccgacaacaaccagggcatttccgtaaacatctaagaggagcactccatgaaacc

SEQ ID NO: 306 - protein, 359 aa, Corynebacterium glutamicum
MSDQKIVVGLLGITHPHASARVRALREIDGVEVVAAADTDSRLQYFTDKYDVEPREIDDVLNDDRINAIMVHSKSKDMVPHAKRALAAGKSVVVEKPGGGTVADLEELLALKEAADPQRIVQVGYNVRLSESVQRLKELLDAGLIGEVVSVQARGAAKVGEHITEHLNQPADMGGVLWILGCHMLDALVEVFGAPESVNARVHKTAKLSDDTSREDSASALLYYPDFSVSFSFDGHDDLEWFESSRLTVYGTKGMIEAGILPQTLRVYLNESRQGWPQGWTEWTQSYFTPPFARTESNKFSELPELENISNFRTEMQGWVNSIRTGSRNVAPVEDALTVARIVSACYESDNNQGISVNI

SEQ ID NO: 307 - DNA, 1212 bp, Corynebacterium glutamicum
  CDS (101)..(1189): RXN00528
ttctgctgggaatccccacattttggaacgtagcgtcgataagcgtgcggcgaagctttttcggtcgcggccgttatctttttaagaggagaaattttagatgagcacgtccaccatcagggttgccattgccggagtcggaaactgcgcgacctccctcattcagggtgtggaatattaccgaaatgcggatccttccgaaactgtcccgggtttgatgcacgtcaaattcggtgattaccacgttggcgacattgaattcgtggccgcgttcgacgtcgacgccgaaaaagtaggcatcgatcttgccgacgccaccgaggcttcacaaaactgcactatcaaaatcgccgatgtcccacagaccggcatcaacgtgctgcgtggcccgactctcgacggcctgggcgatcattaccgcgcgaccatcgacgagtccaccgccgagccagtcgacgttgtccaggcgcttatcgacgcaaaagccgatgttttggtgtcctacctcccagtgggctccgaagaagccgacaaattctacgcacaagccgccatcgatgcaggctgcgcctttgtcaacgctctcccagtattcatcgcctccgaccctgagtgggctaagaagttcactgacgctggcatcccaattgttggcgatgacatcaaatcccagatcggtgcaaccatcacccaccgtgtcctcgcacgcctttttgaagaacgtggcgttcgcgtagatcgcaccatgcagctcaacgtcggcggcaacatggacttcaaaaacatgcttgaccgcaatcgcttggaatccaagaaggtctccaaaacccaagcagtgacctccaacattccagatggtccactgtctggaaaggtggaagaccgcaacgtccacatcggaccatccgaccacgtccaatggctcgatgaccgcaagtgggcttatgtccgcctcgaaggcaccgcattcggtggagttcccctcaaccttgagtacaaactcgaggtgtgggattcacccaactctgccggcatcatcatcgacgctgttcgcgccgccaagatcgccctcgatcgcggtatcggcggaccgatcatgccagcaagctcctacctgatgaagtccccacctgagcagcttccagacgatgttgcttgtgaacgcctagaggcattcatcatcgaggcgtaaaattaggctaaaaatttggg

SEQ ID NO: 308 - protein, 363 aa, Corynebacterium glutamicum
MSTSTIRVAIAGVGNCATSLIQGVEYYRNADPSETVPGLMHVKFGDYHVGDIEFVAAFDVDAEKVGIDLADATEASQNCTIKIADVPQTGINVLRGPTLDGLGDHYRATIDESTAEPVDVVQALIDAKADVLVSYLPVGSEEADKFYAQAAIDAGCAFVNALPVFIASDPEWAKKFTDAGIPIVGDDIKSQIGATITHRVLARLFEERGVRVDRTMQLNVGGNMDFKNMLDRNRLESKKVSKTQAVTSNIPDGPLSGKVEDRNVHIGPSDHVQWLDDRKWAYVRLEGTAFGGVPLNLEYKLEVWDSPNSAGIIIDAVRAAKIALDRGIGGPIMPASSYLMKSPPEQLPDDVACERLEAFIIEA

SEQ ID NO: 309 - DNA, 795 bp, Corynebacterium glutamicum
  CDS (101)..(772): RXN03057
catcaacgccgagtacaactaaggacaactgataatgacaaatgctgcaattgtcggatgaggagacgtcgcaaccgttcatacagaagcgctggaagctttggcttccgatcttggtattaagttcgtcgcagtggtggataaagatctagagactgctgagaaatttgcgacgggacttggagctgctggcgattcttcagaaagcagcgtcaaggcccacggcagcctgccggctttgttctccaaaaagaagatcgatgttctacacatcaccaccccccacgaccaacacattggtttggctctcgaagcgctacaccacggtgtaaatgtcatcctggaaaagccgttggctaatgagttggaccaggcgcagcgtctcatcgactacttggatgaaaaccccgatggtccaaagattgcagtgtgctatcagaaccgttacaacgtttcctcccaggaactgcgtcgtctgctcgattcaggtgacctcggtgccatcaatggtgcatattcctctgtggtgtggacccgcaccccaggctactacacccagaaaccttggcgtggccagcaagcacactccggtggtggcctgctgatgaaccaagcaattcacaccctggatctgctgcagtggttccttggaaaggcaacagaagtcaagggcactgtctccaccgataagtatgccgatgtcatcgatgttgaagacaccgcacacgcatacatcggtcacgagtccggagtccacaccagtgaagtgagttgaaccatgctattggtgataca

SEQ ID NO: 310 - protein, 224 aa, Corynebacterium glutamicum
LASDLGIKFVAVVDKDLETAEKFATGLGAAGDSSESSVKAHGSLPALFSKKKIDVLHITTPHDQHIGLALEALHHGVNVILEKPLANELDQAQRLIDYLDENPDGPKIAVCYQNRYNVSSQELRRLLDSGDLGAINGAYSSVVWTRTPGYYTQKPWRGQQAHSGGGLLMNQAIHTLDLLQWFLGKATEVKGTVSTDKYADVIDVEDTAHAYIGHESGVHTSEVS

SEQ ID NO: 311 - DNA, 795 bp, Corynebacterium glutamicum; identical to SEQ ID NO: 309
  CDS (101)..(772): FRXA02902

SEQ ID NO: 312 - protein, 224 aa, Corynebacterium glutamicum; identical to SEQ ID NO: 310

SEQ ID NO: 313 - DNA, 831 bp, Corynebacterium glutamicum
  CDS (101)..(808): RXA00251
aaccagcgttttcagcgagatactggacatatcaactaaaatccctgaataaaacatctaacatgggttttatacagaaaattcatacgaaaggttgatcatgaagaagaagattgcggtcgttaccggagcgaccggaggcatgggaattgagatcgtcaaagacctctcccgcgaccacattgtctacgccttgggccgaaatccagagcatctggcagctctcgcagagatcgagggagtagagcctatcgagtccgatatcgtgaaggaagtgttggaagagggaggcgtcgacaagctaaaaaacctcgaccacgtggatacgctggtgcacgccgcggcggtggcgcgtgacacgaccatcgaagccggcagtgtggccgaatggcacgcacaccttgatctcaacgtcattgtcccggccgagttgagtcgccaactcttgcccgccctccgcgcggcatccggctgcgtcatctacatcaactccggcgccggcaacggaccacaccccggcaacaccatctacgccgccagcaaacacgccctccgcggactcgccgacgccttccgcaaagaagaagccaacaacggcatccgcgtcagcactgtcagccccggccccaccaacacccccatgctgcaaggcctcatggactcacaaggcaccaacttccgcccagagatctacatcgaaccaaaagaaatcgccaacgcaatcagattcgtgattgacgctggcgaaaccacccagatcaccaacgtggacgtacgaccacgtatcgaactggcggaccggaaagattagttctggggggcttcctgggc

SEQ ID NO: 314 - protein, 236 aa, Corynebacterium glutamicum
MKKKIAVVTGATGGMGIEIVKDLSRDHIVYALGRNPEHLAALAEIEGVEPIESDIVKEVLEEGGVDKLKNLDHVDTLVHAAAVARDTTIEAGSVAEWHAHLDLNVIVPAELSRQLLPALRAASGCVIYINSGAGNGPHPGNTIYAASKHALRGLADAFRKEEANNGIRVSTVSPGPTNTPMLQGLMDSQGTNFRPEIYIEPKEIANAIRFVIDAGETTQITNVDVRPRIELADRKD

SEQ ID NO: 315 - DNA, 1008 bp, Corynebacterium glutamicum
  CDS (101)..(985): RXN02654
tattttcggaaatttatacagcaatcctcgaaatcctaataaagatcccttatcgtgggagaggtacggtagttcgttcgaggacaacgtcgagaaaggcatgatttcattgctaaatgatccacgtacgctattcccgaaagtcgatcccccaaagcaaagccagccggaaccaggcctagatataaaactttccccccaagccgatattggtctctccagctatcaaggaagtggaaggcttaagggccgcaaggctcttattactggtggcgattctgggattggagctgccgtagcaatcgcttatgctcgcgagggggcagatgttgcgatcgcttacttgcccgaagaacaagccgatgctgacagagtgctccaagcaatcgaggaaacaggtcaaaaagctttttctttccctggtgatctccgtgatccagaatactgtcgctcgctggtccaagagacggtgaacgctttaggtggcctagacatcttggtcaacaacgcgtcacgtcaggtgtgggcacctggtttgaccgaaattaccgacgaaaacttcgaccagactttgcaggttaacctctatggtagttttcgggttaccaaagcagctatacctcatctgaagcccggatcatcgataatctttacatcgtccattcaggcgtaccaaccttcggaaaccctcttggattacgccatgactaaggcggcattgaacaatttgtcaaagggcttggcaagtagtctgataggcgatggcattcgggtaaattctgtagccccaggtcctttctggacgccgttgcaacccagccatggtcagccacaagagaaaatagaaggatttggccagcacgctccgattggaagagcgggtcaccctgttgagttggcaggtgcgtacgtttttctcgcttctgacgaagccagctatgtggtaggagaaaccctgggagtcacaggtgggacgcccaccccatagtcggtacaagcggaatcact

SEQ ID NO: 316 - protein, 295 aa, Corynebacterium glutamicum
MISLLNDPRTLFPKVDPPKQSQPEPGLDIKLSPQADIGLSSYQGSGRLKGRKALITGGDSGIGAAVAIAYAREGADVAIAYLPEEQADADRVLQAIEETGQKAFSFPGDLRDPEYCRSLVQETVNALGGLDILVNNASRQVWAPGLTEITDENFDQTLQVNLYGSFRVTKAAIPHLKPGSSIIFTSSIQAYQPSETLLDYAMTKAALNNLSKGLASSLIGDGIRVNSVAPGPFWTPLQPSHGQPQEKIEGFGQHAPIGRAGHPVELAGAYVFLASDEASYVVGETLGVTGGTPTP

SEQ ID NO: 317 - DNA, 1008 bp, Corynebacterium glutamicum; identical to SEQ ID NO: 315
  CDS (101)..(985): FRXA02654

SEQ ID NO: 318 - protein, 295 aa, Corynebacterium glutamicum; identical to SEQ ID NO: 316

SEQ ID NO: 319 - DNA, 1605 bp, Corynebacterium glutamicum
  CDS (101)..(1582): RXN01049
aagcacagcaattgagcaatactcccatgcatgttttcgcgtgatcacgctatatccttaaagaatattctttattagtcagacctttaaaggaaaccttatgggatcaattccaacaatgtccatcccttttgatgactcacgtggaccttatgtccttgctatggatattggttccactgcatcacgaggtggactttatgatgcttccggctgcccaatcaaaggcaccaagcagcgcgaatcccatgaattcaccaccggtgagggcgtttccaccattgatgctgaccaggtggtttcggagatcacctcagttattaatggcattttgaacgcggctgatcatcacaacatcaaagatcagatcgccgctgtcgcgctagattcttttgcatcctcattaatcttggtcgatggtgaaggcaatgcgctcaccccgtgcattacctacgcggattctcgttctgcacagtatgtggagcagctgcgcgcggaaatcgatgagaaggcctaccacggccgcaccggcgtctgcttgcacacctcctaccacccatcgcgcttgctgtggctgaaaactgagttcgagaaagagttcaacaaagccaagtatgtgatgaccatcggtgagtacgtctacttcaaacttgcaggcatcaccggaatggctacttcgattgccgcgtggagtggcattttggacgcccataccggcgaacttgatctgactatcttggagcacatcggtgttgatccggctctgttcggtgagatcagaaaccctgatgaaccagccaccgatgccaaagttgtcgacaaaaagtggaagcacctggaagaaatcccttggttccatgccattccagacggctggccttccaacattggcccaggcgccgtggattctaaaaccgtcgcagtcgccgccgctacatccggcgccatgcgcgtgatccttccgagcgttcccgaacagatcccctctggcctgtggtgttaccgcgtttcccgcgaccagtgcatcgttggtggcgcactcaacgacgtcggacgcgccgtcacctggctggaacgcaccattatcaagcctgaaaacctcgacgaagtgctgatccgcgaacccctcgaaggcaccccagctgtcctgccgttcttctccggggaacgctccatcggctgggcagcctcagcgcaggccacgatcaccaacattcaggaacaaaccggccctgaacacttgtggcgcggcgttttcgaagccctcgcactctcctaccagcgcgtttgggaacacatggggaaagccggcgcagcccctgaacgggtcatcgcatcaggacgagtctccaccgaccacccagaattcctcgcgatgctttccgacgccctcgacaccccagtcatccctctggaaatgaagcgcgccaccctccgcggcaccgcacttatcgtccttgagcagctcgaaccaggcggcacgcgcgcgacgccaccattcggcacgacgcatcagccgcgctttgcgcaccattactccaaggcaagagagcttttcgacgccctctacctcaagttggtctagcttttcgcagtggaacgcgc

SEQ ID NO: 320 - protein, 494 aa, Corynebacterium glutamicum
MGSIPTMSIPFDDSRGPYVLAMDIGSTASRGGLYDASGCPIKGTKQRESHEFTTGEGVSTIDADQVVSEITSVINGILNAADHHNIKDQIAAVALDSFASSLILVDGEGNALTPCITYADSRSAQYVEQLRAEIDEKAYHGRTGVCLHTSYHPSRLLWLKTEFEKEFNKAKYVMTIGEYVYFKLAGITGMATSIAAWSGILDAHTGELDLTILEHIGVDPALFGEIRNPDEPATDAKVVDKKWKHLEEIPWFHAIPDGWPSNIGPGAVDSKTVAVAAATSGAMRVILPSVPEQIPSGLWCYRVSRDQCIVGGALNDVGRAVTWLERTIIKPENLDEVLIREPLEGTPAVLPFFSGERSIGWAASAQATITNIQEQTGPEHLWRGVFEALALSYQRVWEHMGKAGAAPERVIASGRVSTDHPEFLAMLSDALDTPVIPLEMKRATLRGTALIVLEQLEPGGTRATPPFGTTHQPRFAHHYSKARELFDALYLKLV

SEQ ID NO: 321 - DNA, 1134 bp, Corynebacterium glutamicum
  CDS (101)..(1111): FRXA01049
cacagtatgtggagcagctgcgcgcggaaatcgatgagaaggcctaccacggccgcaccggcgtctgcttgcacacctcctaccacccatcgcgcttgctgtggtgaaaactgagttcgagaaagagttcaacaaagccaagtatgtgatgaccatcggtgagtacgtctacttcaaacttgcaggcatcaccggaatggctacttcgattgccgcgtggagtggcattttggacgcccataccggcgaacttgatctgactatcttggagcacatcggtgttgatccggctctgttcggtgagatcagaaaccctgatgaaccagccaccgatgccaaagttgtcgacaaaaagtggaagcacctggaagaaatcccttggttccatgccattccagacggctggccttccaacattggcccaggcgccgtggattctaaaaccgtcgcagtcgccgccgctacatccggcgccatgcgcgtgatccttccgagcgttcccgaacagatcccctctggcctgtggtgttaccgcgtttcccgcgaccagtgcatcgttggtggcgcactcaacgacgtcggacgcgccgtcacctggctggaacgcaccattatcaagcctgaaaacctcgacgaagtgctgatccgcgaacccctcgaaggcaccccagctgtcctgccgttcttctccggggaacgctccatcggctgggcagcctcagcgcaggccacgatcaccaacattcaggaacaaaccggccctgaacacttgtggcgcggcgttttcgaagccctcgcactctcctaccagcgcgtttgggaacacatggggaaagccggcgcagcccctgaacgggtcatcgcatcaggacgagtctccaccgaccacccagaattcctcgcgatgctttccgacgccctcgacaccccagtcatccctctggaaatgaagcgcgccaccctccgcggcaccgcacttatcgtccttgagcagctcgaaccaggcggcacgcgcgcgacgccaccattcggcacgacgcatcagccgcgctttgcgcaccattactccaaggcaagagagcttttcgacgccctctacctcaagttggtctagcttttcgcagtggaacgcgc

SEQ ID NO: 322 - protein, 337 aa, Corynebacterium glutamicum
VVKTEFEKEFNKAKYVMTIGEYVYFKLAGITGMATSIAAWSGILDAHTGELDLTILEHIGVDPALFGEIRNPDEPATDAKVVDKKWKHLEEIPWFHAIPDGWPSNIGPGAVDSKTVAVAAATSGAMRVILPSVPEQIPSGLWCYRVSRDQCIVGGALNDVGRAVTWLERTIIKPENLDEVLIREPLEGTPAVLPFFSGERSIGWAASAQATITNIQEQTGPEHLWRGVFEALALSYQRVWEHMGKAGAAPERVIASGRVSTDHPEFLAMLSDALDTPVIPLEMKRATLRGTALIVLEQLEPGGTRATPPFGTTHQPRFAHHYSKARELFDALYLKLV

SEQ ID NO: 323 - DNA, 597 bp, Corynebacterium glutamicum
  CDS (101)..(574): FRXA01050
aagcacagcaattgagcaatactcccatgcatgttttcgcgtgatcacgctatatccttaaagaatattctttattagtcagacctttaaaggaaaccttatgggatcaattccaacaatgtccatcccttttgatgactcacgtggaccttatgtccttgctatggatattggttccactgcatcacgaggtggactttatgatgcttccggctgcccaatcaaaggcaccaagcagcgcgaatcccatgaattcaccaccggtgagggcgtttccaccattgatgctgaccaggtggtttcggagatcacctcagttattaatggcattttgaacgcggctgatcatcacaacatcaaagatcagatcgccgctgtcgcgctagattcttttgcatcctcattaatcttggtcgatggtgaaggcaatgcgctcaccccgtgcattacctacgcggattctcgttctgcacagtatgtggagcagctgcgcgcggaaatcgatgagaaggcctaccacggccgcaccggcgtctgcttgcacacctcctaccacccatcgcgcttgctgtggtgaaaactgagttcgagaaagag

SEQ ID NO: 324 - protein, 158 aa, Corynebacterium glutamicum
MGSIPTMSIPFDDSRGPYVLAMDIGSTASRGGLYDASGCPIKGTKQRESHEFTTGEGVSTIDADQVVSEITSVINGILNAADHHNIKDQIAAVALDSFASSLILVDGEGNALTPCITYADSRSAQYVEQLRAEIDEKAYHGRTGVCLHTSYHPSRLLW

SEQ ID NO: 325 - DNA, 1065 bp, Corynebacterium glutamicum
  CDS (101)..(1042): RXA00202
ctggcagcagattgtcatcggttgtgtcatcgcgcttgcggtgggcttcgatgtcatccgaaacaaaacctctaagtaattcctgaaaggaaattttcacatgtacgctcgtaaacttattgctctgtccgcttctgtcgttttggctttcagcttgtctgcttgcaaccgtgaatcttctggcaccagcgcagacggcggttctgcggatgggtcgatcaccttggctctgtctacccagaccaacccgttctttgtgcagcttcgtgatggtgcccaggaaaaggctgatgaattgggcgtgaccctcaatgttcaggatgcttccgatgacgctgcaacgcaggccaaccagctcaacaacgctgtcaccaccggtgctggcgtggtgattgtcaacccaactgattctgatgctgtggtgccgtcggtggaagctctcaaccaggctgacattcctgttgtggctgtcgaccgttcctccaatggtggcgaggtggcgtccttcgtggcatctgacaacgttgctggcggcgcgcaggctgctgcagccctggcagaggcgatcggtggcgaaggtgaaatcctcatgctgcaaggcattgcgggatcctctgcatcacgtgatcgtggacagggatttgaagaggagatcgctaagcatgagggcatttccattgtggctaagcagaccgccaactttgaccgcggtgagggcctggacgtggcaactaacctgctgcaggcacaccccaatgtgaaggcgatcttcgcggaaaacgatgagatggcgttgggcgcaatcgaagccctgggtgctcgtgctggtgaagatgtcatcgttgtcggtttcgatggcaccaatgatggtctggcagcggttgaagatggacgcatgttggccaccgttgctcagcagccagaagagctgggagcaaaggctgtggaagaagcagctaagctcctgcgcggtgaggacgctgaaacagaggtaccagttgaggttgtcactgtgaagctcgacaacgtcgcggacttcaagtagtcggcgatgaaaaagtccgt

SEQ ID NO: 326 - protein, 314 aa, Corynebacterium glutamicum
MYARKLIALSASVVLAFSLSACNRESSGTSADGGSADGSITLALSTQTNPFFVQLRDGAQEKADELGVTLNVQDASDDAATQANQLNNAVTTGAGVVIVNPTDSDAVVPSVEALNQADIPVVAVDRSSNGGEVASFVASDNVAGGAQAAAALAEAIGGEGEILMLQGIAGSSASRDRGQGFEEEIAKHEGISIVAKQTANFDRGEGLDVATNLLQAHPNVKAIFAENDEMALGAIEALGARAGEDVIVVGFDGTNDGLAAVEDGRMLATVAQQPEELGAKAVEEAAKLLRGEDAETEVPVEVVTVKLDNVADFK

SEQ ID NO: 327 - DNA, 1077 bp, Corynebacterium glutamicum
  CDS (101)..(1054): RXN00872
gaaatgtattgctttgtcaggacaatgtgttattgtcatgacatgcgatcgtgagggtcgccacattccatcaaaaatgagtgaagggttgcatcgccacatgactaacttgacgagcactcacgaagtcctagctatcggccgcttgggcgtagatatttacccacttcaaagtggagtaggactggccgatgttcaatctttcggcaagtacctcggcggaagcgcagcaaacgtttctgttgcagccgcccgccatggacacaattccgcactgctgtcccgtgtgggaaatgatcctttcggcgagtacctgcttgctgagctggagcgtttgggcgtggacaaccagtacgttgccaccgatcagacttttaagaccccagtgaccttctgtgaaattttcccaccggatgatttcccactgtacttctaccgcgaaccaaaggctccggatctcaatattgaatccgcagacgtcagcctggacgatgtgcgcgaagccgatattttgtggttcacactcactggtttcagtgaagagccaagccgcggcacacaccgcgagatcttgactactcgtgcgaaccgtcgccacaccatctttgatctggactaccgaccaatgttctgggaatccccagaagaggccaccaagcaggcggaatgggcgttgcagcattccacggtggcggttggcaacaaggaagaatgcgaaatcgcagtgggcgagaccgagccagagcgcgcgggccgagcactgttggaacgcggtgtggagttggccatcgtcaagcagggacctaagggtgtcatggcgatgaccaaggacgaaaccgtagaagttcctccgttcttcgtcgatgtcatcaacggtcttggtgccggcgatgcattcggcggcgcgctgtgccacggtctgctctctgaatggccgttggaaaaggttctccgttttgccaacaccgcgggtgcgcttgtggcgtcccgtcttgaatgctccaccgcaatgcctactaccgatgaggtggaagcctccctcaaccagaaagtctgatatgactcctccgattatct

SEQ ID NO: 328 - protein, 318 aa, Corynebacterium glutamicum
MTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYRPMFWESPEEATKQAEWALQHSTVAVGNKEECEIAVGETEPERAGRALLERGVELAIVKQGPKGVMAMTKDETVEVPPFFVDVINGLGAGDAFGGALCHGLLSEWPLEKVLRFANTAGALVASRLECSTAMPTTDEVEASLNQKV

SEQ ID NO: 329 - DNA, 622 bp, Corynebacterium glutamicum
  CDS (101)..(622): FRXA00872
gaaatgtattgctttgtcaggacaatgtgttattgtcatgacatgcgatcgtgagggtcgccacattccatcaaaaatgagtgaagggttgcatcgccacatgactaacttgacgagcactcacgaagtcctagctatcggccgcttgggcgtagatatttacccacttcaaagtggagtaggactggccgatgttcaatctttcggcaagtacctcggcggaagcgcagcaaacgtttctgttgcagccgcccgccatggacacaattccgcactgctgtcccgtgtgggaaatgatcctttcggcgagtacctgcttgctgagctggagcgtttgggcgtggacaaccagtacgttgccaccgatcagacttttaagaccccagtgaccttctgtgaaattttcccaccggatgatttcccactgtacttctaccgcgaaccaaaggctccggatctcaatattgaatccgcagacgtcagcctggacgatgtgcgcgaagccgatattttgtggttcacactcactggtttcagtgaagagccaagccgcggcacacaccgcgagatcttgactactcgtgcgaaccgtcgccacaccatctttgatctggactaccga

SEQ ID NO: 330 - protein, 174 aa, Corynebacterium glutamicum
MTNLTSTHEVLAIGRLGVDIYPLQSGVGLADVQSFGKYLGGSAANVSVAAARHGHNSALLSRVGNDPFGEYLLAELERLGVDNQYVATDQTFKTPVTFCEIFPPDDFPLYFYREPKAPDLNIESADVSLDDVREADILWFTLTGFSEEPSRGTHREILTTRANRRHTIFDLDYR

SEQ ID NO: 331 - DNA, 1767 bp, Corynebacterium glutamicum
  CDS (101)..(1744): RXN00799
ttgtctaaccccgtataggtgagaaatgttggacaagtgtctgttttttgtgggggaaatctgactacgatggtaagaaataaggaaagagattaccattatgtctcaagagcggcctcaaatcggctcccgcctctctcgtgtcattgaacaagacggcctacaattccgcgatctcgacggcgacggcgtacttgcaccttatgaagattggcgtctaaccccagcagagcgtgccgctgacctggtgaaacgtatgaatgtggaagaaaaagcgggcctgatgatcatcggttcgcactaccccggatactcgcctttggcgccggagagtgaaggcaaagacgcggaaaagtgcgagcctttgctgaaccctgtcgatatgtggcgtgaggataacccgatcacgggtgttcctttcaccgagcctgtgctggcaacttcttccactgaaaatgccattaacctgcgcaatcagcgttacttaattgttcgtgacaacctgccagctcgtgggcttgctacttggaccaatgctgttcaggaagtcgcggagcgatcccgtttgggtattcctgttgcgtttgcgtcgaatcctcgtaaccacgtcgcgctcgttgcgcagttcggtgtgaacgagtccgcgggtgtgttctctgagtggcctggcgagctgggtcttgctgcgcttcgcgatgctgaactgatggagactttcggtaccgaggctgctaaagaatggcgtgccggtggtgtgcacaagctgtacggttacatggctgacctcgcttctgagcctcgttggtcccgcttcaacggtacttttggtgaggatccggagttgatctctgattacatcgctgctgttgtgcgtggtttgcagggccctgagctgtccaagaattccgtgtcgaccaccattaagcacttcccaggtggcggcgtgcgcctcgacggccacgatcctcacttccactggggtcagaccaatgagtacccaaccgaagatgcgctgggcaagtaccatctgcctcctttccaggcagctatcgacgctggctgcgcctcgatcatgccttactacgcacggccaatgaacaactccgccaaccagctcgatcagcagctgtggcaaaacccgaccacgcagttcgaagaggttgcgtttgcctacaaccgcaccttcattcaggatttgcttcgcgacgccatgggccaccgtgggtacgtcaactccgactccggcgtcatcgacgccatgatgtggggcgtggaggaactcagcgagccagaacgcttcgccgcagcagtgcgtgcaggcaccgacattttctccgacatggctaacccacgtcgactgctcgaagcagttgctgagggacaccttgatgagtcagagctgaatcagccagtccagcgactcctggaggaaatcttccagcttggtctgtttgagaacccatatgtctctgaagatgaagcagaaaagatcattggtgcgccagaggtttctgcattgggcaacaaagcacagcttgattccgtcaccttgctgcgtaacaaccccatccgtgctgccactggatcctgcagcaagcctgaagatctacccattggttactggccgtaccaagatcgacgaggttcaactacagctggaagcagccattcgcgcagaactcccaggggtaaccttggtgtcttccgagtcagaagcagatcttgcaatcgtgtgggctcgccctgaaattgcactgtttgaagatg

SEQ ID NO: 332 - protein, 548 aa, Corynebacterium glutamicum
MSQERPQIGSRLSRVIEQDGLQFRDLDGDGVLAPYEDWRLTPAERAADLVKRMNVEEKAGLMIIGSHYPGYSPLAPESEGKDAEKCEPLLNPVDMWREDNPITGVPFTEPVLATSSTENAINLRNQRYLIVRDNLPARGLATWTNAVQEVAERSRLGIPVAFASNPRNHVALVAQFGVNESAGVFSEWPGELGLAALRDAELMETFGTEAAKEWRAGGVHKLYGYMADLASEPRWSRFNGTFGEDPELISDYIAAVVRGLQGPELSKNSVSTTIKHFPGGGVRLDGHDPHFHWGQTNEYPTEDALGKYHLPPFQAAIDAGCASIMPYYARPMNNSANQLDQQLWQNPTTQFEEVAFAYNRTFIQDLLRDAMGHRGYVNSDSGVIDAMMWGVEELSEPERFAAAVRAGTDIFSDMANPRRLLEAVAEGHLDESELNQPVQRLLEEIFQLGLFENPYVSEDEAEKIIGAPEVSALGNKAQLDSVTLLRNNPIRAATGSCSKPEDLPIGYWPYQDRRGSTTAGSSHSRRTPRGNLGVFRVRSRSCNRVGSP

SEQ ID NO: 333 - DNA, 1607 bp, Corynebacterium glutamicum
  CDS (1)..(1584): FRXA00799
ctacaattccgcgatctcgacggcgacggcgtacttgcaccttatgaagattggcgtctaaccccagcagagcgtgccgctgacctggtgaaacgtatgaatgtggaagaaaaagcgggcctgatgatcatcggttcgcactaccccggatactcgcctttggcgccggagagtgaaggcaaagacgcggaaaagtgcgagcctttgctgaaccctgtcgatatgtggcgtgaggataacccgatcacgggtgttcctttcaccgagcctgtgctggcaacttcttccactgaaaatgccattaacctgcgcaatcagcgttacttaattgttcgtgacaacctgccagctcgtgggcttgctacttggaccaatgctgttcaggaagtcgcggagcgatcccgtttgggtattcctgttgcgtttgcgtcgaatcctcgtaaccacgtcgcgctcgttgcgcagttcggtgtgaacgagtccgcgggtgtgttctctgagtggcctggcgagctgggtcttgctgcgcttcgcgatgctgaactgatggagactttcggtaccgaggctgctaaagaatggcgtgccggtggtgtgcacaagctgtacggttacatggctgacctcgcttctgagcctcgttggtcccgcttcaacggtacttttggtgaggatccggagttgatctctgattacatcgctgctgttgtgcgtggtttgcagggccctgagctgtccaagaattccgtgtcgaccaccattaagcacttcccaggtggcggcgtgcgcctcgacggccacgatcctcacttccactggggtcagaccaatgagtacccaaccgaagatgcgctgggcaagtaccatctgcctcctttccaggcagctatcgacgctggctgcgcctcgatcatgccttactacgcacggccaatgaacaactccgccaaccagctcgatcagcagctgtggcaaaacccgaccacgcagttcgaagaggttgcgtttgcctacaaccgcaccttcattcaggatttgcttcgcgacgccatgggccaccgtgggtacgtcaactccgactccggcgtcatcgacgccatgatgtggggcgtggaggaactcagcgagccagaacgcttcgccgcagcagtgcgtgcaggcaccgacattttctccgacatggctaacccacgtcgactgctcgaagcagttgctgagggacaccttgatgagtcagagctgaatcagccagtccagcgactcctggaggaaatcttccagcttggtctgtttgagaacccatatgtctctgaagatgaagcagaaaagatcattggtgcgccagaggtttctgcattgggcaacaaagcacagcttgattccgtcaccttgctgcgtaacaaccccatccgtgctgccactggatcctgcagcaagcctgaagatctacccattggttactggccgtaccaagatcgacgaggttcaactacagctggaagcagccattcgcgcagaactcccaggggtaaccttggtgtcttccgagtcagaagcagatcttgcaatcgtgtgggctcgccctgaaattgcactgtttgaagatg

SEQ ID NO: 334 - protein, 528 aa, Corynebacterium glutamicum
LQFRDLDGDGVLAPYEDWRLTPAERAADLVKRMNVEEKAGLMIIGSHYPGYSPLAPESEGKDAEKCEPLLNPVDMWREDNPITGVPFTEPVLATSSTENAINLRNQRYLIVRDNLPARGLATWTNAVQEVAERSRLGIPVAFASNPRNHVALVAQFGVNESAGVFSEWPGELGLAALRDAELMETFGTEAAKEWRAGGVHKLYGYMADLASEPRWSRFNGTFGEDPELISDYIAAVVRGLQGPELSKNSVSTTIKHFPGGGVRLDGHDPHFHWGQTNEYPTEDALGKYHLPPFQAAIDAGCASIMPYYARPMNNSANQLDQQLWQNPTTQFEEVAFAYNRTFIQDLLRDAMGHRGYVNSDSGVIDAMMWGVEELSEPERFAAAVRAGTDIFSDMANPRRLLEAVAEGHLDESELNQPVQRLLEEIFQLGLFENPYVSEDEAEKIIGAPEVSALGNKAQLDSVTLLRNNPIRAATGSCSKPEDLPIGYWPYQDRRGSTTAGSSHSRRTPRGNLGVFRVRSRSCNRVGSP

SEQ ID NO: 335 - DNA, 1632 bp, Corynebacterium glutamicum
  CDS (101)..(1609): RXA00032
cacttgctgaagacgcccacatcgaagaccttgcagatgtaaacgcaaacgcctaactgtttttcgagctaaacccatccttgaaaggatcttttccaccatgaacaccccactccagctcaacactgaaaacctgcaggaaatcgcttcgacttccggagtgcagatcccagcgttcaaccgcgctgacgtcgccccgggcattgtccacttcggtgttggcggattccatcgcgctcaccaagcgatgtacctcaatgaattgatgaatgagggcaaggccttggattggggcatcatcggcatgggtgtcatgccttccgatgtgcgcatgcgcgatgccctggccagccaagatcacctttataccctgaccactaaagctcctgatggaactcttgatcaaaaaatcatcggatccatcattgactacgtgttcgctcccgaggacccagcacgggccgttgcaaccctcgcgcaggactccatccgcattgtttccctcacggtgactgaaggcggatacaacatcgatccggcgacagaagatttcgaccacaccaaccctcgaatcgttgctgaccgcgaagccctgcaggcgggcgatacttccactttgcagaccttctttgggttgatcactgccgcattgatttcccgaaaagaatcaggatctacgccatttaccatcatgagctgcgataacatccaaggcaacggcgatctggctaagcgtttcttcctcgccttcgcacattccgtgtcttctgagctcggcgaatgggtggaaaacaacgtggccttccccaactccatggtggaccgcatcacccctgaaaccaccgacggcgaccgcgatgacatcaaggaaatcggctacatcgatgcgtggccagtggtttctgaagatttcacccaatgggtcctcgaggatgccttcacccagggccgccccgcgtacgaggaggttggcgtgcaggtcgtctccgacgtggagccttatgaattaatgaagctgcgcctgctcaacgcctcccaccagggactttgctacttcggccacttggctggccaccacatggtccacgacgtcatggcggatacccgcttccaggatttcctcctggcttacatggagcgcgaagccacccctaccctcaaggaacttccaggtgtcgatctagatgcttatcgacgccaactcatcgcgcgattcggcaacgccgcagtcaaagacaccgtaccgcgcctgtgtgcggaatcctccgaccgcattccaaagtggctgttgccagtcgtacgcgaaaacctcgcagcaggccgcgacgtcacactttctgcagccatcgtcgcatcctgggcgcgctacgcagaaggcaccgacgagcagggcaacccaataaagattgttgaccgtttgagtgagcgcgtccaagaaaacgcatcaggaaatcgcaccgatattttgtcattcatccgcgaccgtggaatcttcggagacttggtcgatgctgaaccattcaccaaggcatactccgagacactgtcctcccttcatgaccgtggcgcggaagcaaccatcgatgcacttcttacgcaggtaactgtctaaatccgttgcgcgctagggtt

SEQ ID NO: 336 - protein, 503 aa, Corynebacterium glutamicum
MNTPLQLNTENLQEIASTSGVQIPAFNRADVAPGIVHFGVGGFHRAHQAMYLNELMNEGKALDWGIIGMGVMPSDVRMRDALASQDHLYTLTTKAPDGTLDQKIIGSIIDYVFAPEDPARAVATLAQDSIRIVSLTVTEGGYNIDPATEDFDHTNPRIVADREALQAGDTSTLQTFFGLITAALISRKESGSTPFTIMSCDNIQGNGDLAKRFFLAFAHSVSSELGEWVENNVAFPNSMVDRITPETTDGDRDDIKEIGYIDAWPVVSEDFTQWVLEDAFTQGRPAYEEVGVQVVSDVEPYELMKLRLLNASHQGLCYFGHLAGHHMVHDVMADTRFQDFLLAYMEREATPTLKELPGVDLDAYRRQLIARFGNAAVKDTVPRLCAESSDRIPKWLLPVVRENLAAGRDVTLSAAIVASWARYAEGTDEQGNPIKIVDRLSERVQENASGNRTDILSFIRDRGIFGDLVDAEPFTKAYSETLSSLHDRGAEATIDALLTQVTV

SEQ ID NO: 337 - DNA, 1098 bp, Corynebacterium glutamicum
  CDS (101)..(1075): RXA02528
ctggcgcggtatcgattacaatctggttggttatcggtggtttgtggatgaatgtcatcggactctggtaatcgaaaattaaaggtaagggggtgtggagatgtcagcaaaatcgagcctcaaggaagttgctgagttagctggagtcggttatgccacagcctcgagggcactatctggcaaggggtatgtgtccccgcagacgcgggagaaagttcaggcggcggctaaagagctgaactatgtaccaaatcagctggccaaggcgttgcgggaacatcgcagtgccttggtgggggtcattgttccggatttgtccaatgagtattattcggaatcgctgcagactattcagcaggatctgaaagctgctggctatcaaatgctggttgcggaggccaacagtgtgcaggcgcaggacgtggtgatggaatcgttgatctcgattcaagctgcaggaattatccacgttccagtggtcggctcaattgctcctgaaggaatccccatggtgcagttgactcgtggtgaattgggtcctggtttccctcgggtgttgtgtgatgatgaggctgggttttttcagctgaccgagtcggtgctgggcggcagcggaatgaacattgctgctttggttggtgaagaatcactttccaccacgcaggaacgaatgcgcggtattagtcatgcggcgtcgatatatggggctgaggtgacgttccattttggccactattctgtcgaatctggcgaagagatggctcaggtggtgtttaacaacggccttcccgatgcattgattgtggcgtctcctcggctgatggctggggtgatgcgtgcttttactcgcctgaatgtccgcgttccccacgatgtggtgattggtggttatgacgatcctgagtggtacagctttgtcggcgcggggattaccacgtttgttccaccgcatgaggagatggggaaagaggccgtgcgcttgttggtagatctgattgaaaatcccgaacttcccaccggcgatgtggttttgcaggggcaggtgatccttcgggggtcgagcacacattccgggtagaattgcccaaatgtcatcaa

SEQ ID NO: 338 - protein, 325 aa, Corynebacterium glutamicum
MSAKSSLKEVAELAGVGYATASRALSGKGYVSPQTREKVQAAAKELNYVPNQLAKALREHRSALVGVIVPDLSNEYYSESLQTIQQDLKAAGYQMLVAEANSVQAQDVVMESLISIQAAGIIHVPVVGSIAPEGIPMVQLTRGELGPGFPRVLCDDEAGFFQLTESVLGGSGMNIAALVGEESLSTTQERMRGISHAASIYGAEVTFHFGHYSVESGEEMAQVVFNNGLPDALIVASPRLMAGVMRAFTRLNVRVPHDVVIGGYDDPEWYSFVGAGITTFVPPHEEMGKEAVRLLVDLIENPELPTGDVVLQGQVILRGSSTHSG

SEQ ID NO: 339 - DNA, 1246 bp, Corynebacterium glutamicum
  CDS (101)..(1246): RXN00316
agcgcatgatcgatgcctgcgagtccgcaggggtccaacttggcgtgctcttccagcgccgcttctggcccgcggctcaaaaaatgaaaaaggagccgtcatgggccaatgcacggtagcgctttaccgagagcattcctattacacagcaaccccatggcgaggaacctgggcagccgatggcggtggagtgctcatgactcaagccatccactacatcgatcttttgtactggctgttgggcgaacccgtggaagttttcggctacaccaactccttcaaacacggcgacaacatcgaagtcgaagacagcgccgttgccactgtgcgttttgaatcgggcgcgttggccacaatttcagccaccaccgccgcagagccagcactcggcgcacaagtgcaggtgatgggaacaaagggtgccaccatgacgatcctggaattccctgaaggtaccgacggcaggctcattgttcgcagtgaaaacgacacccgtcgaaaccaccccattccaccccgcggatctttatcccaatgccgatctttccatcatcaacggtgctttgatcccgtatcacaccgcccagatcgcagactttatcgatgcgctcaacgaaggccgcccaccactgatcaccggccgcgatgccaccagagctctgaaagttctccttggtgtctacgaatcagcagccacccaccagccggtctctttgatctaacggaagcttttaaaacgtcacgccaaatcggtcttgcacctttatcctccctgtccacaccacctgatcaactagtgcgcctcgcagctgccactggtttctcctttgtcggtctgcgcgtcatcgcagtaacccccaacgaacgtgtatatgacctttccccaggatccccactgctggctgcaacccaacaagcgttgaaagaaaccgccctgtatgtgctcgacactgaattcctacaggtaaacgcagacaccacccgcgaggcctggcttcccgcactagaagccgccggagcactgggagctaaaaccttcaccatcgccgccggtgatgacaacattgcgcccctgaccgacacgatcggtgccatggttgacgatgcccgtgatttcggagtcaccccagccctagagccaatctcttaccgcagcgtgcattccattccgcaggcagcagcaatcgccagagactccggcggaaaagtcgtggcggacaccttgcacatggccaggttcggagcc

SEQ ID NO: 340 - protein, 382 aa, Corynebacterium glutamicum
MGQCTVALYREHSYYTATPWRGTWAADGGGVLMTQAIHYIDLLYWLLGEPVEVFGYTNSFKHGDNIEVEDSAVATVRFESGALATISATTAAEPALGAQVQVMGTKGATMTILEFPEGTDGRLIVRSENDTRRNHPIPPRGSLSQCRSFHHQRCFDPVSHRPDRRLYRCAQRRPPTTDHRPRCHQSSESSPWCLRISSHPPAGLFDLTEAFKTSRQIGLAPLSSLSTPPDQLVRLAAATGFSFVGLRVIAVTPNERVYDLSPGSPLLAATQQALKETALYVLDTEFLQVNADTTREAWLPALEAAGALGAKTFTIAAGDDNIAPLTDTIGAMVDDARDFGVTPALEPISYRSVHSIPQAAAIARDSGGKVVADTLHMARFGA

SEQ ID NO: 341 - DNA, 412 bp, Corynebacterium glutamicum
  CDS (101)..(412): FRXA00309
agcgcatgatcgatgcctgcgagtccgcaggggtccaacttggcgtgctcttccagcgccgcttctggcccgcggctcaaaaaatgaaaaaggagccgtcatgggccaatgcacggtagcgctttaccgagagcattcctattacacagcaaccccatggcgaggaacctgggcagccgatggcggtggagtgctcatgactcaagccatccactacatcgatcttttgtactggctgttgggcgaacccgtggaagttttcggctacaccaactccttcaaacacggcgacaacatcgaagtcgaagacagcgccgttgccactgtgcgttttgaatcgggcgcgttggccacaatttcagccaccaccgccgcagagccagcactcggcgcacaagtgcaggtgatggga

SEQ ID NO: 342 - protein, 104 aa, Corynebacterium glutamicum
MGQCTVALYREHSYYTATPWRGTWAADGGGVLMTQAIHYIDLLYWLLGEPVEVFGYTNSFKHGDNIEVEDSAVATVRFESGALATISATTAAEPALGAQVQVMG

SEQ ID NO: 343 - DNA, 558 bp, Corynebacterium glutamicum
  CDS (101)..(535): RXN00310
ttgcgggattcatcatcggcgcaatcgcactgtctgccgcagttattttgaccaccaaggaaaccgccttcaccaagcttgaagatctagggaagaaataatgtctgacaagatctggaaagtcggcatcatcggttgcggtgcaatcagccgaaaccatatcgaagcagttcaggcaatccccggcgcagaagtcagcgcagtctgtgatgtggatggtgcgaaagcatcggaaaccgcagcgaaatatggaatttctcccagtttcacgtctgtcgatgagatcctcgcctccggggtggacattgtcgcagtctgcaccccacatccaacccacgaaacagtggtcctcgccgctgctgccgccggagtgcacgtgctttgtgagaagccaatcgccatcgaactcgattccgcacagcgcatgatcgatgcctgcgagtccgcaggggtccaacttggcgtgctcttccagcgccgcttctggcccgcggctcaaaaaatgaaaaaggagccgtcatgggccaatgcacggtagcgctttaccgagagcattcc

SEQ ID NO: 344 - protein, 145 aa, Corynebacterium glutamicum
MSDKIWKVGIIGCGAISRNHIEAVQAIPGAEVSAVCDVDGAKASETAAKYGISPSFTSVDEILASGVDIVAVCTPHPTHETVVLAAAAAGVHVLCEKPIAIELDSAQRMIDACESAGVQLGVLFQRRFWPAAQKMKKEPSWANAR

SEQ ID NO: 345 - DNA, 558 bp, Corynebacterium glutamicum; identical to SEQ ID NO: 343
  CDS (101)..(535): FRXA00310

SEQ ID NO: 346 - protein, 145 aa, Corynebacterium glutamicum; identical to SEQ ID NO: 344

SEQ ID NO: 347 - DNA, 1342 bp, Corynebacterium glutamicum
  CDS (101)..(1342): RXA00041
atgaagcagcagcatccaagctggaaaacgctgatcactaccgtctcatggagcaattaaagctgcgctagaaacaaaaaggaaagtagtgtgtggggctatgcacacagaactttccagtttgcgccctgcgtaccatgtgactcctccgcagggcaggctcaatgatcccaacggaatgtacgtcgatggcgataccctccacgtctactaccagcacgatccaggtttccccttcgcaccaaagcgcaccggctgggctcacaccaccacgccgttgaccggaccgcagcgattgcagtggacgcacctgcccgacgctctttacccggatgcatcctatgacctggatggatgctattccggtggagccgtatttactgacggcacacttaaacttttctacaccggcaacctaaaaattgacggcaagcgccgcgccacccaaaacctcgtcgaagtcgaggacccaactgggctgatgggcggcattcatcgccgttcgcctaaaaatccgcttatcgacggacccgccagcggtttcacaccccattaccgcgatcccatgatcagccctgatggtgatggttggaaaatggttcttggggcccaacgcgaaaacctcaccggtgcagcggttctataccgctcgacagatcttgaaaactgggaattctccggtgaaatcacctttgacctcagtgatgcacaacctggttctgctcctgatctcgttcccggtggctacatgtgggaatgccccaacctttttacgcttcgcgatgaagaaactggcgaagatctcgacgtgctgattttctgtccacaaggattggaccgaatccacgatgaggttactcactacgcaagctctgaccagtgcggatatgtcgtcggcaagcttgaaggaacgaccttccgcgtcttgcgaggattcagcgagctggatttcggccatgaattctacgcaccgcaggttgcagtaaacggttctgatgcctggctcgtgggctggatggggctgcccgcgcaggatgatcacccaacagttgcacgggaaggatgggtgcactgcctgactgtgccccgcaagcttcatttgcgcaaccacgcgatctatcaagagcttcttctcccagagggggagtcaggggtaatcagatctgtattaggttctgaacctgtccgagtagacatccgaggcaatatttccctcgagtgggatggtgtccgtttgtctgtggatcgtggtggtgatcgtcgcgtagctgaggtaaaacctggcgaattagtgatcgcggacgataatacagccattgagataactgcaggtgatggacag

SEQ ID NO: 348 - protein, 414 aa, Corynebacterium glutamicum
MHTELSSLRPAYHVTPPQGRLNDPNGMYVDGDTLHVYYQHDPGFPFAPKRTGWAHTTTPLTGPQRLQWTHLPDALYPDASYDLDGCYSGGAVFTDGTLKLFYTGNLKIDGKRRATQNLVEVEDPTGLMGGIHRRSPKNPLIDGPASGFTPHYRDPMISPDGDGWKMVLGAQRENLTGAAVLYRSTDLENWEFSGEITFDLSDAQPGSAPDLVPGGYMWECPNLFTLRDEETGEDLDVLIFCPQGLDRIHDEVTHYASSDQCGYVVGKLEGTTFRVLRGFSELDFGHEFYAPQVAVNGSDAWLVGWMGLPAQDDHPTVAREGWVHCLTVPRKLHLRNHAIYQELLLPEGESGVIRSVLGSEPVRVDIRGNISLEWDGVRLSVDRGGDRRVAEVKPGELVIADDNTAIEITAGDGQ

SEQ ID NO: 349 - DNA, 720 bp, Corynebacterium glutamicum
  CDS (1)..(720): RXA02026
ccatttcatatacaaccagaaacaggtttattaaatgatcccaacggacttattttttataaagggaagtattatgtttcacatcaatggttcccattaggcgcagtacatggcttaaagtattggtataactacacgagtgatgacttaataaactttaaacctgaagggccaatattaaatccagatactaaatatgacagccatggtgtttatagcggtagcgcttttgaatataacgggcatttatattatatgtacacaggaaatcatcgagataatcattggcaacgacatgcgagtcagatgatcgcacgattgaaagaagacggttcagttgaaaagtttccaaagccagtaattagccagcaaccagaaggatatacaagtcattttagagatcctaaagtttttaaatatggtgagaaatattatgcaatcattggcgcacaaaataatgatcagcaaggtcgattattactttataatactgaagatataattaattggcattatttaggtgaaataaatacagagttagatgattttggatatatgtgggaatgcccagattactttaatttagataatcaagatgtcatacttatttgtccacaaggtattgaaccaaaaggcaatcagttcaaaaatatttatcaaagtggttatatacttggaaagtttgatattgaaaagttaacatatgaacatgaaaatttt

SEQ ID NO: 350 - protein, 240 aa, Corynebacterium glutamicum
PFHIQPETGLLNDPNGLIFYKGKYYVSHQWFPLGAVHGLKYWYNYTSDDLINFKPEGPILNPDTKYDSHGVYSGSAFEYNGHLYYMYTGNHRDNHWQRHASQMIARLKEDGSVEKFPKPVISQQPEGYTSHFRDPKVFKYGEKYYAIIGAQNNDQQGRLLLYNTEDIINWHYLGEINTELDDFGYMWECPDYFNLDNQDVILICPQGIEPKGNQFKNIYQSGYILGKFDIEKLTYEHENF

SEQ ID NO: 351 - DNA, 1617 bp, Corynebacterium glutamicum
  CDS (101)..(1594): RXA02061
taacctgccttcacctgggattatccacccatgtgtgatgaaatcgctaccctgaatcaaagacactggcgtaattgagtgaaggcaggacaataaagagatgacgaacgtttccgggtatcaccgaccagagctgcacatcaccgctgaaagtggtgttttgtttgcacctgcaggcgttctgttggatgacgacacgtggcatttcttccaccagtaccgtccctcaccagatcacggccccaggtgggcgcaccaattcgcagagcgcactccatttgtgtgggatatctgcgatgacgtgctagcccctgaaggcgatgaaacccaggttcgcgctggctcagtggtgtccaacaacggtggcgttgatctgtacttcacctcggttgttggccccacttccactatccagttggcacacatcaacaacatccgtggcaccaccgaactgatcaatgaggacgagctggggctcgatccagatgtctcccgaatcggcgaagtggttggcaacactgatggttatgtaaagttccgctcaccgtgcgttatcccaggttgggaagaccaaggaaaccgcgatgaaggccactcaggatggttgatgctcgcagttactggcccagttgaagccccaacagtagtggtcctcgactcgccagatggaagagaatggtccattacaggtcccctgtctctcaacggcctctctggattagagtcagacgaagttctagttgctcctcgcatgattcgtctgcgcgatgaagtggatcatgaaatctacgatgtcctcattgtcaccattgaacaagacgggattgacatttcgggatacctggtaggccagctcaacggctcagaattcgatgtgaagactccatttacccgcatcgattttggccatgatttctctcgcccccgcaacaccaactacgccgaaaccaccatcggctacgacttcgcccacatctttggtctcatgaatggcgtaggtcgtttggactcccccactgagcatctcagttggaaggaagaaggctgggcaaacgctatttctttcccacgtattgtcacgctccaggacggtacggtcttccagacccctccagaaggattgcttgatgccattcatgaatccgaggcagcggcaggttggaccggactgtgcgaaatcccatcaaacagcgcagttgaagtggcgttgaaggaccaagaaggtgaaatcgctgcaacaatcactcaccgccacaatcagctagtcgttgatcggtccatgaaccccaaccacgcgggtgatccacacgcgattgcaccattgactgatgatgaaacagattcactgttcattgtcgttgacggctctacagtagaagtttttgctgatggcggttatgtatcaatggcaagccgtgtgtatttcaacaacggaccattcagcgaatttgaggtcaccaccaccggtgacgcaagcattattcgccaggaaagtcacttccctgttgatttcagttcggtgtccctagatatagatgatctcactgcgctcatgcagttcgatgaaaacgaaccgcatgaaggcccagtgagataagagttagatgcgttccagcc

SEQ ID NO: 352 - protein, 498 aa, Corynebacterium glutamicum
MTNVSGYHRPELHITAESGVLFAPAGVLLDDDTWHFFHQYRPSPDHGPRWAHQFAERTPFVWDICDDVLAPEGDETQVRAGSVVSNNGGVDLYFTSVVGPTSTIQLAHINNIRGTTELINEDELGLDPDVSRIGEVVGNTDGYVKFRSPCVIPGWEDQGNRDEGHSGWLMLAVTGPVEAPTVVVLDSPDGREWSITGPLSLNGLSGLESDEVLVAPRMIRLRDEVDHEIYDVLIVTIEQDGIDISGYLVGQLNGSEFDVKTPFTRIDFGHDFSRPRNTNYAETTIGYDFAHIFGLMNGVGRLDSPTEHLSWKEEGWANAISFPRIVTLQDGTVFQTPPEGLLDAIHESEAAAGWTGLCEIPSNSAVEVALKDQEGEIAATITHRHNQLVVDRSMNPNHAGDPHAIAPLTDDETDSLFIVVDGSTVEVFADGGYVSMASRVYFNNGPFSEFEVTTTGDASIIRQESHFPVDFSSVSLDIDDLTALMQFDENEPHEGPVR

SEQ ID NO: 353 - DNA, 1305 bp, Corynebacterium glutamicum
  CDS (101)..(1282): RXN01369
ctgcgacggacctagcaaaggggcgctgacacaagcactgcgtttgctggtgcgcggacagtcagccacgacctattccattgaagaaaaggacttgtaaatggagctattggaaggctcactgcgcacctacccatggggttcaagaacactgatcgctgatctcaaaggcgaagaatcaccatcgtctcgcccagaggccgaagtctggttcggtgcccacccaggatcaccatcaaccatcggtggaaacgcactcaacgaagtcatcgcagcgaaccccgaagaagcattgggcacgcgtgttgccgaagcgtttgaaaatgagcttccattcctcctcaaaatcctcgcagcgggagcacccctatcactgcaggcccacccatcgctggaacaggcccgtgaaggattcgcccgcgaaaactcagcaggaattgacctcggcgcaccgaaccgcaactaccgcgacccaaaccacaagccagagctgatcgttgctctcacggaattcatcgcgatggcaggcttccgcccactgcggaacaccctcaccattttcgacgccctcgcctgcgaacccctcgaccgctaccgcagcatgctcaccgtcgacaacgaggaagaatccctccgcgcactgtttaccacctggatcaccatccccatcggtaaacgacacgaactcatcgatgccctcatcagcaacgcccacacctaccttgaggcaagcgatcgtgacgaggacatcgcattcgtgctctcacacatcatcgagctcaacgaacagtaccccggcgatgtcggcgttctgggtgctctgctgttgaacttctacaaacttgccccaggcgaagccctctacctcgacgccgcaaaccttcacgcatacatcagcggcctcggcgtagagatcatggcgaactccgacaacgtgctccgcggtggactgacatccaaatacgtcgacgtcccggagcttgtgcgcgtgttggatttcaactctttggaaaacgctcgcgtggacgttgaagaagacggtgcaacgacccactacccagttccaatcaacgaattccaactcgatcgcgttgcagttcagggcgaagcagaagccaaccacgatggtcccatgattgttctgtgcacctccggaactgtttccttggaagcaggggagaagaccctcgaagtagcagcaggtcacgccgcatgggttccagcaaacgacccaaccattgcgatgcgttctgaggacgcagaagtattcctcgctagggtttagatctttttagattaaaatca

SEQ ID NO: 354 - protein, 394 aa, Corynebacterium glutamicum
MELLEGSLRTYPWGSRTLIADLKGEESPSSRPEAEVWFGAHPGSPSTIGGNALNEVIAANPEEALGTRVAEAFENELPFLLKILAAGAPLSLQAHPSLEQAREGFARENSAGIDLGAPNRNYRDPNHKPELIVALTEFIAMAGFRPLRNTLTIFDALACEPLDRYRSMLTVDNEEESLRALFTTWITIPIGKRHELIDALISNAHTYLEASDRDEDIAFVLSHIIELNEQYPGDVGVLGALLLNFYKLAPGEALYLDAANLHAYISGLGVEIMANSDNVLRGGLTSKYVDVPELVRVLDFNSLENARVDVEEDGATTHYPVPINEFQLDRVAVQGEAEANHDGPMIVLCTSGTVSLEAGEKTLEVAAGHAAWVPANDPTIAMRSEDAEVFLARV

SEQ ID NO: 355 - DNA, 524 bp, Corynebacterium glutamicum
  CDS (1)..(501): FRXA01369
aacgaacagtgcctcggcgatgtcggcgttctgggtgctctgctgttgaacttctacaaacttgccccaggcgaagccctctacctcgacgccgcaaaccttcacgcatacatcagcggcctcggcgtagagatcatggcgaactccgacaacgtgctccgcggtggactgacatccaaatacgtcgacgtcccggagcttgtgcgcgtgttggatttcaactctttggaaaacgctcgcgtggacgttgaagaagacggtgcaacgacccactacccagttccaatcaacgaattccaactcgatcgcgttgcagttcagggcgaagcagaagccaaccacgatggtcccatgattgttctgtgcacctccggaactgtttccttggaagcaggggagaagaccctcgaagtagcagcaggtcacgccgcatgggttccagcaaacgacccaaccattgcgatgcgttctgaggacgcagaagtattcctcgctagggtttagatctttttagattaaaatca

SEQ ID NO: 356 - protein, 167 aa, Corynebacterium glutamicum
NEQCLGDVGVLGALLLNFYKLAPGEALYLDAANLHAYISGLGVEIMANSDNVLRGGLTSKYVDVPELVRVLDFNSLENARVDVEEDGATTHYPVPINEFQLDRVAVQGEAEANHDGPMIVLCTSGTVSLEAGEKTLEVAAGHAAWVPANDPTIAMRSEDAEVFLARV

SEQ ID NO: 357 - DNA, 808 bp, Corynebacterium glutamicum
  CDS (101)..(808): FRXA01373
ctgcgacggacctagcaaaggggcgctgacacaagcactgcgtttgctggtgcgcggacagtcagccacgacctattccattgaagaaaaggacttgtaaatggagctattggaaggctcactgcgcacctacccatggggttcaagaacactgatcgctgatctcaaaggcgaagaatcaccatcgtctcgcccagaggccgaagtctggttcggtgcccacccaggatcaccatcaaccatcggtggaaacgcactcaacgaagtcatcgcagcgaaccccgaagaagcattgggcacgcgtgttgccgaagcgtttgaaaatgagcttccattcctcctcaaaatcctcgcagcgggagcacccctatcactgcaggcccacccatcgctggaacaggcccgtgaaggattcgcccgcgaaaactcagcaggaattgacctcggcgcaccgaaccgcaactaccgcgacccaaaccacaagccagagctgatcgttgctctcacggaattcatcgcgatggcaggcttccgcccactgcggaacaccctcaccattttcgacgccctcgcctgcgaacccctcgaccgctaccgcagcatgctcaccgtcgacaacgaggaagaatccctccgcgcactgtttaccacctggatcaccatccccatcggtaaacgacacgaactcatcgatgccctcatcagcaacgcccacacctaccttgaggcaagcgatcgtgacgaggacatcgcattcgtgctctcacacatcatcgagctcaacgaacagtaccccggcgatgtcggc

SEQ ID NO: 358 - protein, 236 aa, Corynebacterium glutamicum
MELLEGSLRTYPWGSRTLIADLKGEESPSSRPEAEVWFGAHPGSPSTIGGNALNEVIAANPEEALGTRVAEAFENELPFLLKILAAGAPLSLQAHPSLEQAREGFARENSAGIDLGAPNRNYRDPNHKPELIVALTEFIAMAGFRPLRNTLTIFDALACEPLDRYRSMLTVDNEEESLRALFTTWITIPIGKRHELIDALISNAHTYLEASDRDEDIAFVLSHIIELNEQYPGDVG

SEQ ID NO: 359 - DNA, 1775 bp, Corynebacterium glutamicum
  CDS (1)..(1752): RXA02611
gatgcgtggtcggatcctatggctacgtggcgtcatgcgattaccactaagattgaggccggccagggttcggatgagttgtataacgactttgagcacggggctcagctgtttgagcgtgctgcggagaatttgtctaaagaggataggactgcgcttttcgacgtcgcctcctctctgcggcgcggcggcgatgtacgcgcacgtctcgccccagcgctcaccgcgagtgtcactcatcttttagaacttaacccgttgcgtgagttggtcacgatgggtgaaaacctgcaggttcgtgtcgagcgtcgtgccgctttggtcaactcttggtatgagcttttccctcgttccacaggtggttgggatgagtccggcacccccgttcatggcactttcgctaccactgctcaggcgttggagcgtgtcgcgaagatgggcttcgatactgtttacttcccgccgatccatccgattggcgaggtcaaccgcaagggccgcaataatacgctgaccccggaacctcatgatgtgggttcgccgtgggctattggttctaaagatggtgggcatgatgcaacgcatccgcggttgggcaccattgaagatttccaggcgttgttggctcgcgcacgggaactcaatttggaagttgcactcgatctagctctgcaggctgcccctgatcatccatgggcgcaggaacaccgcgagtttttcacggtgttggctgatggcaccattgcgtatgcagaaaacccaccgaagaagtaccaggatatttatcccatcaactttgataatgatgctccgaagatctacgaagaggtctatcgtgtggtgaagttctgggtggatttgggtgtgaccacattccgcgtggataacccgcacactaagcccgctaatttctggcagtggcttatttctgccatccataaatcaaaccctgaggtcattttcctagcggaggcgtctactcgcccggcacgtctgtatttcttgtccaagattggtttctcccagtcttacacctacttcacctggaaggtcaccaacgaggagctcaccgagttcgctactgagatcgcccccatggcggatatttctcgtccgaacctgtttgtgaacactcccgacattttgcatgcgtctctgcagcatggtggacgcgccatgttcgctatccgcgccgcattggccgccacgatgtctcctgtgtggggcgtatattccggatatgagctctttgagcacgaggccgtcaagcctggttcggaagagtacttggattctgagaagtacgagctgcgtccccgcgatttcgagggtgctctggaacgtggcgattctctcgaggattacatcgctctgctcaaccagatccgtcgcgcgaaccctgccttgcagcaactacgcaacatccacttccacgaagcggacaatgatcagatcatcgcctactccaaggttgatgctttgaccggaaataccgtgttgattgtggtcaacttggatccacgtagtgctcgtgaggctactgttcgccttgatcttggagcgcttggcttagaagcgggtgcacagtttgaggtgcgcgatgcgatcaccggctcccgttacctgtggtcagagacgaactttgtccgcctcgagcccctacgcgatgtcgcccacatctttgttcttcctgaacttccagcgtctcgccgtgagcgtctcgcgtggcgcgaaatcaagacctaccgcgcgtaatttcccatctctgtaccttc

SEQ ID NO: 360 - protein, 584 aa, Corynebacterium glutamicum
DAWSDPMATWRHAITTKIEAGQGSDELYNDFEHGAQLFERAAENLSKEDRTALFDVASSLRRGGDVRARLAPALTASVTHLLELNPLRELVTMGENLQVRVERRAALVNSWYELFPRSTGGWDESGTPVHGTFATTAQALERVAKMGFDTVYFPPIHPIGEVNRKGRNNTLTPEPHDVGSPWAIGSKDGGHDATHPRLGTIEDFQALLARARELNLEVALDLALQAAPDHPWAQEHREFFTVLADGTIAYAENPPKKYQDIYPINFDNDAPKIYEEVYRVVKFWVDLGVTTFRVDNPHTKPANFWQWLISAIHKSNPEVIFLAEASTRPARLYFLSKIGFSQSYTYFTWKVTNEELTEFATEIAPMADISRPNLFVNTPDILHASLQHGGRAMFAIRAALAATMSPVWGVYSGYELFEHEAVKPGSEEYLDSEKYELRPRDFEGALERGDSLEDYIALLNQIRRANPALQQLRNIHFHEADNDQIIAYSKVDALTGNTVLIVVNLDPRSAREATVRLDLGALGLEAGAQFEVRDAITGSRYLWSETNFVRLEPLRDVAHIFVLPELPASRRERLAWREIKTYRA

SEQ ID NO: 361 - DNA, 2316 bp, Corynebacterium glutamicum
  CDS (101)..(2293): RXA02612
gaacttccagcgtctcgccgtgagcgtctcgcgtggcgcgaaatcaagacctaccgcgcgtaatttcccatctctgtaccttctatcaaggattatcatcatgaccgttgaccccgcgagccacatcaccatccctgaagcagatctggcccgcctgcgccactgcaaccatcacgatcctcatggattttatggttggcatgagaccgaagctggttcggttatccgcacgcgccaggtcggcgcgacgcaggttaatttgcttatcgacgacacctcccacgtcatgacccctatcggcgacgacattttcgcaattgacttaggtcaccgcgagcgcgctgactatcgcttggaagtcacctggcctgatcaagaaccgcaggtcaaggctgatccatactacttcctccccaccgtaggcgagatggatatttacctcttctctgagggacgccatgagcgtttgtgggagattctcggtgccaacatcaagacctaccaaactgcgctcggaacagttcgtggcaccgcatttactgtgtgggctccaaacgcaattggctgcgcagtggtcggtggcttcaacggttggaatgcatcccagcatccgatgcgttctatgggtggttcgggtctgtgggagctgttcatcccaggcatagaggaaggcgaagtgtacaaattcgccgtccaaaccagggaaggccaacgtcgtgataaggccgatccgatggctcgtcgcgcagaactggcgccggcaaccggatctattgtcgcttcctctgagtaccagtggcaggattccgagtggctgcgcgagcgttcccaaactgatctcgcatccaagccaatgagtgtctacgaggtccacctcggttcttggcgctggggtaagaactatgaggatttggctactgagctggttgattacgtcgcagatcttggctacacccacgtggaattcctccctgtcgcagagcaccccttcggtggttcctggggttaccaggtcaccggctactacgcaccgacctctcgttggggtactccagatcagttccgtgcgctagtcgacgctttccacgcccgcggtattggcgtgatcatggactgggttcctgcccacttccctaaggatgattgggctcttgcccgctttgatggcgaagccctctatgaacaccctgactggaggcgcggcgaacaaaaggattggggcaccctggtctttgacttcggtcgcaacgaagtccgcaacttcctcgtcgctaatgcgttgtactggattgaagaattccacatcgatggtctgcgcgtcgacgccgtggcctccatgctgtacctcgattactcccgtgagcacggcgaatgggaaccaaacatctacggtggtcgcgagaacctcgaggcagtgcagttcctgcaggaaatgaacgccacggtgctgcgactgcaccctggtgcgctcaccatcgctgaggaatcaacttcatggcctggcgtgaccgcaccaacgtgggacggcggcttgggattctccctcaagtggaacatgggctggatgcacgacaccttagagtacttctccaaaaaccctgtgcaccgcgcattccaccacagtgagctcactttctccttggtgtacgcattctctgagcgttttgtacttccgatctctcacgatgaagtcgtccacggcaagggttccctgtgggaccgtatgcctggcgatacgtggaacaaggccgctggtcttcgcaccttccttgcgtacatgtggtcacacccaggcaagaagctgcttttcatgggtcaggagtttggtcagcgtgaagagtgggctgaaggccagggactgccatgggatattgtcgacggctggcaaggcgagtaccacgaagccatccgcactctgacccgctccctcaacggtgtctactcagactcccctgcgctgcacactcaggatttcaccggagaaggcttcacatggaataagggcgacgacgccaccaacaacattttggcgttcactcgtttcggcagcgacggctcccagatgctgtgtgtattcaacctgtctggaacctcccagcctgagtaccagctcggtgttgcagcgggtggcgaatggaagctcgttctcaacactgatgatgctgaattcctcggtgcagaaaacgatatcgctacttccgttcaagcagcagcgacaccacgcgataatttcgcctactcactctcactgcatgtcccagcgatgagtgctcagttctactcactgcagaagtaggacacaggaaaatgcatcct

SEQ ID NO: 362 - protein, 731 aa, Corynebacterium glutamicum
MTVDPASHITIPEADLARLRHCNHHDPHGFYGWHETEAGSVIRTRQVGATQVNLLIDDTSHVMTPIGDDIFAIDLGHRERADYRLEVTWPDQEPQVKADPYYFLPTVGEMDIYLFSEGRHERLWEILGANIKTYQTALGTVRGTAFTVWAPNAIGCAVVGGFNGWNASQHPMRSMGGSGLWELFIPGIEEGEVYKFAVQTREGQRRDKADPMARRAELAPATGSIVASSEYQWQDSEWLRERSQTDLASKPMSVYEVHLGSWRWGKNYEDLATELVDYVADLGYTHVEFLPVAEHPFGGSWGYQVTGYYAPTSRWGTPDQFRALVDAFHARGIGVIMDWVPAHFPKDDWALARFDGEALYEHPDWRRGEQKDWGTLVFDFGRNEVRNFLVANALYWIEEFHIDGLRVDAVASMLYLDYSREHGEWEPNIYGGRENLEAVQFLQEMNATVLRLHPGALTIAEESTSWPGVTAPTWDGGLGFSLKWNMGWMHDTLEYFSKNPVHRAFHHSELTFSLVYAFSERFVLPISHDEVVHGKGSLWDRMPGDTWNKAAGLRTFLAYMWSHPGKKLLFMGQEFGQREEWAEGQGLPWDIVDGWQGEYHEAIRTLTRSLNGVYSDSPALHTQDFTGEGFTWNKGDDATNNILAFTRFGSDGSQMLCVFNLSGTSQPEYQLGVAAGGEWKLVLNTDDAEFLGAENDIATSVQAAATPRDNFAYSLSLHVPAMSAQFYSLQK

SEQ ID NO: 363 - DNA, 1913 bp, Corynebacterium glutamicum
  CDS (1)..(1890): RXN01884
gtgactgccattgaattgatgccggtccaccagttcctgcaggatgatcgtctccgcgacctaggaatgcgcaactactggggctacaactctttcggcttctttgcgccctacaacgattacgctgccaacaagaaccccggtggcgccgtggccgagttcaaaggcttggtgcgcagctaccacgaagcgggcctcgaagtaattttggatgtggtctacaaccacaccgccgagggcaaccacatgggccccaccatcgcgttccgaggcattgacaacgaggcgtactaccgactggttgagggcgatcgccgtcattacatggactacaccggtactggtaactccctcaatgtccgcgacccgcactcactgcagctgattatggattcgctgcgctactgggtcaccgagatgcatgtcgacggcttccgcttcgaccttgcctctacccttgctcgtgaatttgatgatgttgaccgcctggcaaccttcttcgacctggtccaacaagacccggtggtctcccaggtcaagctcattgctgagccgtgggatgttggcgaaggcggataccaagtgggtaacttcccaccactgtggactgagtggaacggtaaataccgcgacactgtccgtgatttctggcgtggtgagccagcaaccttgggtgaattcgcttcccgactaactggttcctctgatttgtatgcaaacaacggccgtcgccccactgcatcgatcaactttgtgactgctcacgacggcttcaccctcaatgacttggtcagttacaacgagaagcacaacatggccaacggtgaagacggtcgggacggtgaatcacacaaccgttcctggaactgtggcgtcgaaggaccaactgacgatcctgagattatgcagctgcgtgctcagcaacgacgcaacttcctcaccaccttgttgctgtcccagggcacccctatgttgtcccacggtgatgaaatggcccgtacccaaaacggcaacaacaacgtctactgccaagacaatgaactggcgtgggtgaattgggatcaggctgaagaaaacgctgacttggtgagcttcaccaggcgtttgctgcgtatccgagcaaaccacccagtatttaggcgcaggcagttccttgccggtggccctttgggcgccgatgttcgtgaccgcgatatcgcatggctggtaccaaatggaaccttgatgactcaagatgactgggacttcgctttcggtaaatcactgcaggtgttcttcaacggcgatgccatcgaagagcctgattatcgaggacagaaaatccacgatgactccttcatcttgatgttcaacgctcacttcgaacctatcgatttcaatctccctcctgagcatttcggtatgaagtggaagcttttggtcgataccaccgaagcggtgggccacccgctggaggatctcaccatcgaagctggcggaaccatcactgttcctgcccgttccacgatgctgctgcgccaggtggaggctccggactacaccaagcttgaggaaaagatcgctgctgaaaagcgtgagcaagaacttgcggcagagaaggaagctgctgagaagcgcgaattggaactggcggcagcaaaggaagctgaagatgctgctgaggctctccaccttgcggcagaacgtgcttcgactcaggaagctgaattggcccatcaacacggtgctgatgcgattgccgatgaggtagcggaagaaccacaagagctgccacaagatgaagtagcggcagaggtcgagactgagcccgacaccgagcctgacactgaatctgactccgagcaggctgaggtagcttcagaggagcctgaagcggacgaagaagagaagtagtacaccgaaagtggcgtcgc

SEQ ID NO: 364 - protein, 630 aa, Corynebacterium glutamicum
VTAIELMPVHQFLQDDRLRDLGMRNYWGYNSFGFFAPYNDYAANKNPGGAVAEFKGLVRSYHEAGLEVILDVVYNHTAEGNHMGPTIAFRGIDNEAYYRLVEGDRRHYMDYTGTGNSLNVRDPHSLQLIMDSLRYWVTEMHVDGFRFDLASTLAREFDDVDRLATFFDLVQQDPVVSQVKLIAEPWDVGEGGYQVGNFPPLWTEWNGKYRDTVRDFWRGEPATLGEFASRLTGSSDLYANNGRRPTASINFVTAHDGFTLNDLVSYNEKHNMANGEDGRDGESHNRSWNCGVEGPTDDPEIMQLRAQQRRNFLTTLLLSQGTPMLSHGDEMARTQNGNNNVYCQDNELAWVNWDQAEENADLVSFTRRLLRIRANHPVFRRRQFLAGGPLGADVRDRDIAWLVPNGTLMTQDDWDFAFGKSLQVFFNGDAIEEPDYRGQKIHDDSFILMFNAHFEPIDFNLPPEHFGMKWKLLVDTTEAVGHPLEDLTIEAGGTITVPARSTMLLRQVEAPDYTKLEEKIAAEKREQELAAEKEAAEKRELELAAAKEAEDAAEALHLAAERASTQEAELAHQHGADAIADEVAEEPQELPQDEVAAEVETEPDTEPDTESDSEQAEVASEEPEADEEEK

SEQ ID NO: 365 - DNA, 1496 bp, Corynebacterium glutamicum
  CDS (1)..(1473): FRXA01884
atgcatgtcgacggcttccgcttcgaccttgcctctacccttgctcgtgaatttgatgatgttgaccgcctggcaaccttcttcgacctggtccaacaagacccggtggtctcccaggtcaagctcattgctgagccgtgggatgttggcgaaggcggataccaagtgggtaacttcccaccactgtggactgagtggaacggtaaataccgcgacactgtccgtgatttctggcgtggtgagccagcaaccttgggtgaattcgcttcccgactaactggttcctctgatttgtatgcaaacaacggccgtcgccccactgcatcgatcaactttgtgactgctcacgacggcttcaccctcaatgacttggtcagttacaacgagaagcacaacatggccaacggtgaagacggtcgggacggtgaatcacacaaccgttcctggaactgtggcgtcgaaggaccaactgacgatcctgagattatgcagctgcgtgctcagcaacgacgcaacttcctcaccaccttgttgctgtcccagggcacccctatgttgtcccacggtgatgaaatggcccgtacccaaaacggcaacaacaacgtctactgccaagacaatgaactggcgtgggtgaattgggatcaggctgaagaaaacgctgacttggtgagcttcaccaggcgtttgctgcgtatccgagcaaaccacccagtatttaggcgcaggcagttccttgccggtggccctttgggcgccgatgttcgtgaccgcgatatcgcatggctggtaccaaatggaaccttgatgactcaagatgactgggacttcgctttcggtaaatcactgcaggtgttcttcaacggcgatgccatcgaagagcctgattatcgaggacagaaaatccacgatgactccttcatcttgatgttcaacgctcacttcgaacctatcgatttcaatctccctcctgagcatttcggtatgaagtggaagcttttggtcgataccaccgaagcggtgggccacccgctggaggatctcaccatcgaagctggcggaaccatcactgttcctgcccgttccacgatgctgctgcgccaggtggaggctccggactacaccaagcttgaggaaaagatcgctgctgaaaagcgtgagcaagaacttgcggcagagaaggaagctgctgagaagcgcgaattggaactggcggcagcaaaggaagctgaagatgctgctgaggctctccaccttgcggcagaacgtgcttcgactcaggaagctgaattggcccatcaacacggtgctgatgcgattgccgatgaggtagcggaagaaccacaagagctgccacaagatgaagtagcggcagaggtcgagactgagcccgacaccgagcctgacactgaatctgactccgagcaggctgaggtagcttcagaggagcctgaagcggacgaagaagagaagtagtacaccgaaagtggcgtcgc

SEQ ID NO: 366 - protein, 491 aa, Corynebacterium glutamicum
MHVDGFRFDLASTLAREFDDVDRLATFFDLVQQDPVVSQVKLIAEPWDVGEGGYQVGNFPPLWTEWNGKYRDTVRDFWRGEPATLGEFASRLTGSSDLYANNGRRPTASINFVTAHDGFTLNDLVSYNEKHNMANGEDGRDGESHNRSWNCGVEGPTDDPEIMQLRAQQRRNFLTTLLLSQGTPMLSHGDEMARTQNGNNNVYCQDNELAWVNWDQAEENADLVSFTRRLLRIRANHPVFRRRQFLAGGPLGADVRDRDIAWLVPNGTLMTQDDWDFAFGKSLQVFFNGDAIEEPDYRGQKIHDDSFILMFNAHFEPIDFNLPPEHFGMKWKLLVDTTEAVGHPLEDLTIEAGGTITVPARSTMLLRQVEAPDYTKLEEKIAAEKREQELAAEKEAAEKRELELAAAKEAEDAAEALHLAAERASTQEAELAHQHGADAIADEVAEEPQELPQDEVAAEVETEPDTEPDTESDSEQAEVASEEPEADEEEK

SEQ ID NO: 367 - DNA, 547 bp, Corynebacterium glutamicum
  CDS (101)..(547): RXA01111
agaaaaccctgccgatgcaaactttgaggagagattcaatcaaggaatagaaatcattctggtgggtctagacgcgcttgggcatataagatgacgttccatgacatcaacgattgagcactcgtaccaagtttggcctggacatgcttatcctctgggttcaacctatgacggtgctggaacgaacttcgcactcttctccgacgttgcagagcgtgttgagctgtgtctattagatgcagataacaacgagactcgaattccactcgaagagcgcgatgcccacatttggcattgctaccttcctggcgttcaacctggacagcgctacggattccgagttcatggcccgtggaacccagatgagggtaagcggtgcgacgcgaacaaacttctagttgatccctatgctcgtgctttcgatggagattttgatggacatccgtcactattttcttacgacatcaccaatccaaatgaccccaacggtcgcaataccgaagacagcattgatcacacaatgaagtctgtcgtggtgaacccattc

SEQ ID NO: 368 - protein, 149 aa, Corynebacterium glutamicum
MTSTIEHSYQVWPGHAYPLGSTYDGAGTNFALFSDVAERVELCLLDADNNETRIPLEERDAHIWHCYLPGVQPGQRYGFRVHGPWNPDEGKRCDANKLLVDPYARAFDGDFDGHPSLFSYDITNPNDPNGRNTEDSIDHTMKSVVVNPF

SEQ ID NO: 369 - DNA, 1635 bp, Corynebacterium glutamicum
  CDS (101)..(1612): RXN01550
ttcgccagcagtacttcttcacctctgcttccctgcaggccatgattcagggccacctggcgcaccacaaggacctcagcaactttgccgagttcactccgtgcagctcaatgacactcacccagtgttggctatccctgagcttatgcgtctgctcatggacgagcatgacatgggctgggaagaatcctgggcaatcgtgttcaagaccttcgcatacaccaaccacaccgtgctcaccgaagctcttgagcagtgggatcagcagatcttccaacagctgttctggcgcgtgtgggaaatcatcacagagatcgatcgccgcttccgtttggagcgcgcagccgatggactggatgaagagaccatcgaccgcatggctccaatccagcacggcactgttcatatggcatggattgcctgttacgcggcatattccatcaatggcgtggcagcgctgcacaccgagatcatcaaggccgagaccttggctgactggtacgcactgtggccagagaagttcaacaacaagactaacggtgttaccccacgccgttggctgcgcatgatcaacccaggtctgtctgacctgctcactcgactttccggttccgatgattgggtaaccgatctggatgagctgaagaagctgcgctcctatgccgacgataagtccgtgcttgaagaactccgcgctatcaaggctgctaataagcaagacttcgccgagtggatcctcgagcgccagggcattgagattgatccagaatccatctttgacgtgcagattaagcgcctccacgagtacaagcgccagctcatgaacgcgctctacgtactagacctttacttccgtattaaggaagatggcctcaccgacatcccagcacgcactgtcatctttggcgccaaggccgcgccgggttatgtccgcgccaaggcgattatcaagctcatcaactctattgctgacttggtaaacaacgatcctgaggtctccccgctgctcaaggtggtctttgtagagaactacaacgtctcccctgctgagcacatcttgcctgcgtctgatgtctccgaacagatttccaccgccggcaaggaagccagcggtacctccaacatgaagttcatgatgaacggcgccctcaccctgggcaccatggacggcgccaacgtagagatcgtggattctgtgggcgaggaaaacgcctatatcttcggtgctcgcgtggaagaattgccagccctgcgcgaaagctacgagccatatgagctctatgagaccgtccctggcctcaagcgcgcattggacgccctggataacggcaccctcaacgacaacaacagtggtttgttctacgacctcaagcattccttgatccacggttatggaaaagacgccagcgacacctactacgtgcttggcgatttcgcagattaccgcgagacccgcgaccgtatggccgccgactacgcctccgatcccctgggttgggcacgcatggcctggatcaacatttgcgagtccggccgtttctcctccgaccgcaccatccgcgattatgccaccgagatctggaagctcgagccaactcctgctgttaagaagtaggttttaacctccgcttctaa

SEQ ID NO: 370 - protein, 504 aa, Corynebacterium glutamicum
VQLNDTHPVLAIPELMRLLMDEHDMGWEESWAIVFKTFAYTNHTVLTEALEQWDQQIFQQLFWRVWEIITEIDRRFRLERAADGLDEETIDRMAPIQHGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYEPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 371 - DNA, 1367 bp, Corynebacterium glutamicum
  CDS (1)..(1344): FRXA01550
atcttccaacagctgttctggcgcgtgtgggaaatcatcacagagatcgatcgccgcttccgtttggagcgcgcagccgatggactggatgaagagaccatcgaccgcatggctccaatccagcgcggcactgttcatatggcatggattgcctgttacgcggcatattccatcaatggcgtggcagcgctgcacaccgagatcatcaaggccgagaccttggctgactggtacgcactgtggccagagaagttcaacaacaagactaacggtgttaccccacgccgttggctgcgcatgatcaacccaggtctgtctgacctgctcactcgactttccggttccgatgattgggtaaccgatctggatgagctgaagaagctgcgctcctatgccgacgataagtccgtgcttgaagaactccgcgctatcaaggctgctaataagcaagacttcgccgagtggatcctcgagcgccagggcattgagattgatccagaatccatctttgacgtgcagattaagcgcctccacgagtacaagcgccagctcatgaacgcgctctacgtactagacctttacttccgtattaaggaagatggcctcaccgacatcccagcacgcactgtcatctttggcgccaaggccgcgccgggttatgtccgcgccaaggcgattatcaagctcatcaactctattgctgacttggtaaacaacgatcctgaggtctccccgctgctcaaggtggtctttgtagagaactacaacgtctcccctgctgagcacatcttgcctgcgtctgatgtctccgaacagatttccaccgccggcaaggaagccagcggtacctccaacatgaagttcatgatgaacggcgccctcaccctgggcaccatggacggcgccaacgtagagatcgtggattctgtgggcgaggaaaacgcctatatcttcggtgctcgcgtggaagaattgccagccctgcgcgaaagctacgagccatatgagctctatgagaccgtccctggcctcaagcgcgcattggacgccctggataacggcaccctcaacgacaacaacagtggtttgttctacgacctcaagcattccttgatccacggttatggaaaagacgccagcgacacctactacgtgcttggcgatttcgcagattaccgcgagacccgcgaccgtatggccgccgactacgcctccgatcccctgggttgggcacgcatggcctggatcaacatttgcgagtccggccgtttctcctccgaccgcaccatccgcgattatgccaccgagatctggaagctcgagccaactcctgctgttaagaagtaggttttaacctccgcttctaa

SEQ ID NO: 372 - protein, 448 aa, Corynebacterium glutamicum
IFQQLFWRVWEIITEIDRRFRLERAADGLDEETIDRMAPIQRGTVHMAWIACYAAYSINGVAALHTEIIKAETLADWYALWPEKFNNKTNGVTPRRWLRMINPGLSDLLTRLSGSDDWVTDLDELKKLRSYADDKSVLEELRAIKAANKQDFAEWILERQGIEIDPESIFDVQIKRLHEYKRQLMNALYVLDLYFRIKEDGLTDIPARTVIFGAKAAPGYVRAKAIIKLINSIADLVNNDPEVSPLLKVVFVENYNVSPAEHILPASDVSEQISTAGKEASGTSNMKFMMNGALTLGTMDGANVEIVDSVGEENAYIFGARVEELPALRESYEPYELYETVPGLKRALDALDNGTLNDNNSGLFYDLKHSLIHGYGKDASDTYYVLGDFADYRETRDRMAADYASDPLGWARMAWINICESGRFSSDRTIRDYATEIWKLEPTPAVKK

SEQ ID NO: 373 - DNA, 2348 bp, Corynebacterium glutamicum
  CDS (1)..(2325): RXN02100
ctaggtcgaatcaacgccgaggagcaaaacctcagcgaatacctcagcgacaagctgtggtaccaggacaccgcagatgcaaccgatgctgtcggagatccactcgttgcgtacttctccatggagtttggcattcacccaagcctgccaatctactctggcggacttggtgtgcttgcgggcgagaacatgaagtctgcatctgacttgggtgtgccactgatcggtgttggtttgctctacacccacggctacttcacccagtcactgtccggtgacggttggcagcaggaagagtacaagtaccacgatccagcagaactgccgattgaggcagttaaagataagaacggcgagcaggtcactgtttctgtcacctacccaggtgcgcaggaagtaaagattgcactgtgggtagcaaacgttggccgcatcccattgctgctgcttgataccaacatcgaggcaaacccagaagagctccgcaacgttactgaccgcctgtacggtggcgacaatgagcaccgcatcaagcaggaactcgttctcggtgttggtggcgtccgcgctgtcaacgcattctgcgaagctcgtggtctgaagcgctcatctgttgcacacctcaacgaaggccacgcaggtttcctgaccctggagcgtatccgcgagcgcatcgcagagggcatggagtacccagcagcattcgagcaggttcgtgcgtccaacatcttcaccacccacaccccagtcccagcaggcatcgaccgcttcgacatggagatggtgcgtcgttatctcggtggcggtcagccagaagatcagcagctgtgcgttggtgttccaattgagaaggcacttgagcttggtcaagagtccgatccacaccgcttcaacatggctcatatgggccttcgcgcgagccaacatgctaatggcgtcgcaaagcttcatggtgaagtaagccgtgacatgttcgccggcctgtaccccggatatgagcctcgtgaagtgcccatcgggcacgtcaccaacggtgttcacctgccgacgtgggtcaagccagagatgaaggaactcatcgatcgcgtcactggcggcgctgatcttgcggttgctgattcttggtcaaacccacaggctgtcgagtctgagaagatctggaaggtgcgcaacaagttccgtgctgacctagtggaggttgctcgcgctgcaactgcaaagtcctggtctcaccgtggacacaccgaagcagaacttgcgtggacctcccgcgttctggatccaaacgtgctgaccattggtttcgcacgtcgcgtatccacctacaagcgcttgaccttgatgctgcgcaaccctgaacgcctgcgttccatcttgcttaatgaggaacgcccagttcagttcgttattgctggtaaggcacacccacatgacatgggtggcaagaagctcatgcaggaaatcgtccacttcgctgatcaagctggtgtccgtgaccgtttcctcttcctgcctgattacgacatcaacctggccagctacctgatctctggtgctgacgtgtggctgaacaacccagtgcgccctcaggaagcatcgggaacctccggtatgaaggccgtcatgaatggtggcctgaccctgtccatctctgatggttggtgggatgaaatgcctaaggagaccaccggctggaccatcccaaccgttgagtcccaggacttggaatgccgcgaccacctggaatcccaggcgctgtacgacctgctggaaaacgaagttgcaccgctgttttacaagcgcgacaagaacggcatcccacaggactggctggacctggttcgcgaatcctggaccaccctgtcaccaatggtcacctccacccgcatggtgcgcgactacaccacccagtactaccgcccaaccaaacaccaggcagagctcattgcgcagcctgcagaagcagcggattacgcggcatggcttgagcacatcaaagcagagtgggctggcgtcaaggtctcagacctgaagatcagcgagagcgccatcacggcgcaggagcttgaagtcagcgttcgcgttgattccggttcgcttaacgacgacgagttccaagctcaggcactctttggtgcgctcggacacaacggtgacatcgaagatccagaaatcaccgttttgaccccacgcggcgatggcgcctacgcggcaaaggtcagcactgacctgccaggcaactacggcatcactgcccgcgttgttccaaacaacaggatgctggtcagcccagcggaaacccgcctgatcacctacttggagaactagggcgaaactagctttaccaa

SEQ ID NO: 374 - protein, 775 aa, Corynebacterium glutamicum
LGRINAEEQNLSEYLSDKLWYQDTADATDAVGDPLVAYFSMEFGIHPSLPIYSGGLGVLAGENMKSASDLGVPLIGVGLLYTHGYFTQSLSGDGWQQEEYKYHDPAELPIEAVKDKNGEQVTVSVTYPGAQEVKIALWVANVGRIPLLLLDTNIEANPEELRNVTDRLYGGDNEHRIKQELVLGVGGVRAVNAFCEARGLKRSSVAHLNEGHAGFLTLERIRERIAEGMEYPAAFEQVRASNIFTTHTPVPAGIDRFDMEMVRRYLGGGQPEDQQLCVGVPIEKALELGQESDPHRFNMAHMGLRASQHANGVAKLHGEVSRDMFAGLYPGYEPREVPIGHVTNGVHLPTWVKPEMKELIDRVTGGADLAVADSWSNPQAVESEKIWKVRNKFRADLVEVARAATAKSWSHRGHTEAELAWTSRVLDPNVLTIGFARRVSTYKRLTLMLRNPERLRSILLNEERPVQFVIAGKAHPHDMGGKKLMQEIVHFADQAGVRDRFLFLPDYDINLASYLISGADVWLNNPVRPQEASGTSGMKAVMNGGLTLSISDGWWDEMPKETTGWTIPTVESQDLECRDHLESQALYDLLENEVAPLFYKRDKNGIPQDWLDLVRESWTTLSPMVTSTRMVRDYTTQYYRPTKHQAELIAQPAEAADYAAWLEHIKAEWAGVKVSDLKISESAITAQELEVSVRVDSGSLNDDEFQAQALFGALGHNGDIEDPEITVLTPRGDGAYAAKVSTDLPGNYGITARVVPNNRMLVSPAETRLITYLEN

SEQ ID NO: 375 - DNA, 941 bp, Corynebacterium glutamicum
  CDS (1)..(918): FRXA02100
attgctggtaaggcacacccacatgacatgggtggcaagaagctcatgcaggaaatcgtccacttcgctgatcaagctggtgtccgtgaccgtttcctcttcctgcctgattacgacatcaacctggccagctacctgatctctggtgctgacgtgtggctgaacaacccagtgcgccctcaggaagcatcgggaacctccggtatgaaggccgtcatgaatggtggcctgaccctgtccatctctgatggttggtgggatgaaatgcctaaggagaccaccggctggaccatcccaaccgttgagtcccaggacttggaatgccgcgaccacctggaatcccaggcgctgtacgacctgctggaaaacgaagttgcaccgctgttttacaagcgcgacaagaacggcatcccacaggactggctggacctggttcgcgaatcctggaccaccctgtcaccaatggtcacctccacccgcatggtgcgcgactacaccacccagtactaccgcccaaccaaacaccaggcagagctcattgcgcagcctgcagaagcagcggattacgcggcatggcttgagcacatcaaagcagagtgggctggcgtcaaggtctcagacctgaagatcagcgagagcgccatcacggcgcaggagcttgaagtcagcgttcgcgttgattccggttcgcttaacgacgacgagttccaagctcaggcactctttggtgcgctcggacacaacggtgacatcgaagatccagaaatcaccgttttgaccccacgcggcgatggcgcctacgcggcaaaggtcagcactgacctgccaggcaactacggcatcactgcccgcgttgttccaaacaacaggatgctggtcagcccagcggaaacccgcctgatcacctacttggagaactagggcgaaactagctttaccaa

SEQ ID NO: 376 - protein, 306 aa, Corynebacterium glutamicum
IAGKAHPHDMGGKKLMQEIVHFADQAGVRDRFLFLPDYDINLASYLISGADVWLNNPVRPQEASGTSGMKAVMNGGLTLSISDGWWDEMPKETTGWTIPTVESQDLECRDHLESQALYDLLENEVAPLFYKRDKNGIPQDWLDLVRESWTTLSPMVTSTRMVRDYTTQYYRPTKHQAELIAQPAEAADYAAWLEHIKAEWAGVKVSDLKISESAITAQELEVSVRVDSGSLNDDEFQAQALFGALGHNGDIEDPEITVLTPRGDGAYAAKVSTDLPGNYGITARVVPNNRMLVSPAETRLITYLEN

SEQ ID NO: 377 - DNA, 1206 bp, Corynebacterium glutamicum
  CDS (1)..(1206): FRXA02113
ctaggtcgaatcaacgccgaggagcaaaacctcagcgaatacctcagcgacaagctgtggtaccaggacaccgcagatgcaaccgatgctgtcggagatccactcgttgcgtacttctccatggagtttggcattcacccaagcctgccaatctactctggcggacttggtgtgcttgcgggcgagaacatgaagtctgcatctgacttgggtgtgccactgatcggtgttggtttgctctacacccacggctacttcacccagtcactgtccggtgacggttggcagcaggaagagtacaagtaccacgatccagcagaactgccgattgaggcagttaaagataagaacggcgagcaggtcactgtttctgtcacctacccaggtgcgcaggaagtaaagattgcactgtgggtagcaaacgttggccgcatcccattgctgctgcttgataccaacatcgaggcaaacccagaagagctccgcaacgttactgaccgcctgtacggtggcgacaatgagcaccgcatcaagcaggaactcgttctcggtgttggtggcgtccgcgctgtcaacgcattctgcgaagctcgtggtctgaagcgctcatctgttgcacacctcaacgaaggccacgcaggtttcctgaccctggagcgtatccgcgagcgcatcgcagagggcatggagtacccagcagcattcgagcaggttcgtgcgtccaacatcttcaccacccacaccccagtcccagcaggcatcgaccgcttcgacatggagatggtgcgtcgttatctcggtggcggtcagccagaagatcagcagctgtgcgttggtgttccaattgagaaggcacttgagcttggtcaagagtccgatccacaccgcttcaacatggctcatatgggccttcgcgcgagccaacatgctaatggcgtcgcaaagcttcatggtgaagtaagccgtgacatgttcgccggcctgtaccccggatatgagcctcgtgaagtgcccatcgggcacgtcaccaacggtgttcacctgccgacgtgggtcaagccagagatgaaggaactcatcgatcgcgtcactggcggcgctgatcttgcggttgctgattcttggtcaaacccacaggctgtcgagtctgagaagatctggaaggtgcgcaacaagttccgtgctgacctagtggaggttgctcgc

SEQ ID NO: 378 - protein, 402 aa, Corynebacterium glutamicum
LGRINAEEQNLSEYLSDKLWYQDTADATDAVGDPLVAYFSMEFGIHPSLPIYSGGLGVLAGENMKSASDLGVPLIGVGLLYTHGYFTQSLSGDGWQQEEYKYHDPAELPIEAVKDKNGEQVTVSVTYPGAQEVKIALWVANVGRIPLLLLDTNIEANPEELRNVTDRLYGGDNEHRIKQELVLGVGGVRAVNAFCEARGLKRSSVAHLNEGHAGFLTLERIRERIAEGMEYPAAFEQVRASNIFTTHTPVPAGIDRFDMEMVRRYLGGGQPEDQQLCVGVPIEKALELGQESDPHRFNMAHMGLRASQHANGVAKLHGEVSRDMFAGLYPGYEPREVPIGHVTNGVHLPTWVKPEMKELIDRVTGGADLAVADSWSNPQAVESEKIWKVRNKFRADLVEVAR

SEQ ID NO: 379 - DNA, 1140 bp, Corynebacterium glutamicum
  CDS (101)..(1117): RXA02147
aaaagttgagagcggcttgcttcttttccttggctaggcttttgtaatcgggttagagtagtggagttgcttgaatgaggttgataggggatttttgaagatgtttggtcgccgttgggtgagcgttgtggcgtcatgtgttatcgcaagcacgctgattctggtgccttcgcattccggtgcggaggaagtcgatcaactgattgctgatatcgagcatgtctctcaggaaacgtctgcccagaatgaggaagtcaaacagcttgagattgatattgaggctcgtgaggtcacgatcaaggaagttcaggagcagtcggtaagctaccgtgaggcggctgatcaagcatcggagaatgtcgaagcttatcgttcggagatcaatcggatcgctcaggcgaagtatcgtggcacagtcacggatcctttgagcattgcggtgtctgcagaagatccacaaaacgtgattgatcggatgagctacctttcaacgttgactaagtccactagtgatgtggttgaatccctcaacgcggagactgagaagtccgcagaagctgtgtatcaagcaaaccgtactaaggcggaagcggagttccagttggggcagctgaaggtacgccaggcggagcttgaatctgaaaaggaagcattggatggtcgaaaatcggagatccgagaccgggtggatgccctgacgccacaggagcgggaaatgtgggttgctaagaatggtccattggacattgatctgactgatttgcttggtctttccgctgcgacttcgggtgcggtggatgctgccttgtctaagttgggaagcccttatggttggggtggcattggcccaaatgagtttgattgctcaggtttgatctattgggcgtatcagcagatgggtaagactttgccacgtacgtctcaagctcagatggctggcggaacgccggtgagcagagatgagctgcagcctggcgatgtcattggatattacccaggtgctactcacgtgggactgtatattggggacggaaagattgtgcacgcctcagactacggaatccctgtgcaggtggtatctgttgattcagcaccgttttatggtgcgcgtcgctactaagaaatagttcgtcaggagaa

SEQ ID NO: 380 - protein, 339 aa, Corynebacterium glutamicum
MFGRRWVSVVASCVIASTLILVPSHSGAEEVDQLIADIEHVSQETSAQNEEVKQLEIDIEAREVTIKEVQEQSVSYREAADQASENVEAYRSEINRIAQAKYRGTVTDPLSIAVSAEDPQNVIDRMSYLSTLTKSTSDVVESLNAETEKSAEAVYQANRTKAEAEFQLGQLKVRQAELESEKEALDGRKSEIRDRVDALTPQEREMWVAKNGPLDIDLTDLLGLSAATSGAVDAALSKLGSPYGWGGIGPNEFDCSGLIYWAYQQMGKTLPRTSQAQMAGGTPVSRDELQPGDVIGYYPGATHVGLYIGDGKIVHASDYGIPVQVVSVDSAPFYGARRY

SEQ ID NO: 381 - DNA, 1959 bp, Corynebacterium glutamicum
  CDS (101)..(1936): RXA01478
gcgggttttgttgtggaggggcgcgtcgaaaagcaattttttttccaagatagctcactttattggagtcacctggcctgaaatcctctactctgggcgcatgaccattccaggagcttccacacagactgatatccctctggacacacttcttgaggattacgcgctactgtcagacactcacaccggcgctctgctgtccaacatgggcagtttggactggttgtgcctgcctcgttttgattcccaagccatgttcaccaggctgcttggtgatcgcgagcacggacactggagtttgcgtgtcccaggtggtgaggtgatcagccaaaactacctcggcgattccttcgtggtgcagaccgtgtggcgttcagagaccggtactgcccgggttgttgatttcatgccaattcacggtcaagaacaacccgatatcaccgacctggtgcgctctgtgcactgcgtggaaggcgaagtggatgtggaatcgatcctgcgcctgcgttttgattatggcgagtccactccgtatttccgcaccagcactgtcgacggcatcagcatcgtgcaggctgtcgccggccccaatgcggtatatgttcgtggacctgagatgccacaccgccctgcaaaggattgtcacagtggcaccttccacctgacggccggcgaatccgtggaatgggttctcacctgggcaccgtcgttcgaaccgcatccccccatgccggattacacccgctctttggagagcaccttgagcttctgggcatcatgggttgaagagctcccccaccagcgcctctacgacgctgaagtccgccgctccatgctcgtactgcgcgccttgaccgatctacaaaccggtggcatcgtggccgcaccgaccacctcactaccagaggatttcggaggcatccgtaactgggactaccgctacgtgtggctgcgcgactccgcactcaccattgaagccctcgtggaatacggattctcccaagcagccctccaatggcgcacctggctgctgcgcgccatcgcaggcgacccggaaaacctccgcatcatgtatggcctcggcggcgaacgacacctccctgaacgcgaactccaacacctgcgcggatacgaaaactccgtgcctgttcgcgttggcaatggagccgccgaacaataccaagcagatgtcgtcggcgaagtaatggtcgcgcttgaaaccatccgccgcgccgggtgcctcgaggacgaattctcctggggcatgcaaaaagccatcctcgatttccaagaagccaacttcgaccgcaaggatcaaggcatctgggaaatgcgctccgaaccgcaatatttcacccacggccgcgccatgatgtgggccggcttcgaccgcggcatcaaagccatcgaagaattcaacctcgacggccccatcgagcgctggcgtgaactccgcgccaaactccgcgaagaaatcatgaccaacggcttcaacgaagagatccaatccttcacccagtgctacgacaacacccaagtcgacgcctcgctgcttcagctcgcccaaataggcttcatcggcttcgacgatccaaaaatgctcagcaccgtagcgcgcattgagcaagagcttctcgacgcccacggctttcttcacaggtaccacaccgacgggtctgacggccttgccggcgacgaataccccttcctcatctgttcattctggctggtagaacaatacgcaagctccaaccgcctcgacgaggccaaagaaaagatgaaccgcatccttgccgtccaaagcccacttggcctactggctgaggaatactccacccaccatggcaggctcgctggaaactaccctcaggccttttcccacattggtctgatcagcgctgcccgtgccataaatttcgaagaagcgcgaaacaggtagagtctaaggtgtcattcttg

SEQ ID NO: 382 - protein, 612 aa, Corynebacterium glutamicum
MTIPGASTQTDIPLDTLLEDYALLSDTHTGALLSNMGSLDWLCLPRFDSQAMFTRLLGDREHGHWSLRVPGGEVISQNYLGDSFVVQTVWRSETGTARVVDFMPIHGQEQPDITDLVRSVHCVEGEVDVESILRLRFDYGESTPYFRTSTVDGISIVQAVAGPNAVYVRGPEMPHRPAKDCHSGTFHLTAGESVEWVLTWAPSFEPHPPMPDYTRSLESTLSFWASWVEELPHQRLYDAEVRRSMLVLRALTDLQTGGIVAAPTTSLPEDFGGIRNWDYRYVWLRDSALTIEALVEYGFSQAALQWRTWLLRAIAGDPENLRIMYGLGGERHLPERELQHLRGYENSVPVRVGNGAAEQYQADVVGEVMVALETIRRAGCLEDEFSWGMQKAILDFQEANFDRKDQGIWEMRSEPQYFTHGRAMMWAGFDRGIKAIEEFNLDGPIERWRELRAKLREEIMTNGFNEEIQSFTQCYDNTQVDASLLQLAQIGFIGFDDPKMLSTVARIEQELLDAHGFLHRYHTDGSDGLAGDEYPFLICSFWLVEQYASSNRLDEAKEKMNRILAVQSPLGLLAEEYSTHHGRLAGNYPQAFSHIGLISAARAINFEEARNR

SEQ ID NO: 383 - DNA, 658 bp, Corynebacterium glutamicum
  CDS (101)..(658): RXA01888
agtagatactagataccacccattgatgccgtcaaggggtttcctgtaaagatgtaagagattaagaaaagaggtagatatggcgtcaaagcgaccgacaatggctgatgtggcaaaagctgctggagtatccactgcgctggtctccatcgtgtttcgcgatgcccccggagcaagtgaatccacccgcaaccatgtgaaagaaaaagccgccgaactcggatacattcctgatcgacgagcccaaaaacttcgccaaaaccgctccggactcatcggtgtggcattcgaaatgcaccaagcattccacggcgatatcgtcgaacacctctatcccaccgcccgaaaacatggcttcgacctgtaccttagcgcgatcacaccgactcgcactgaaaaagatgccgtcaacgccctgatcagggaacgatgcgaagcagtaattcttctaggatctcgcatgtcacctagtgatttggaaacaatcgcacagcaacttcccgtccaagtaattgcccgcggttccggaacccccaaagtcagttccgtccatgtcgacgacgcagttggcgcccaattagccctcaaccacctcatcgaattaggccacgaacacatcatctacatcgatggtggcgacgcccctggcacccaggaa

SEQ ID NO: 384 - protein, 186 aa, Corynebacterium glutamicum
MADVAKAAGVSTALVSIVFRDAPGASESTRNHVKEKAAELGYIPDRRAQKLRQNRSGLIGVAFEMHQAFHGDIVEHLYPTARKHGFDLYLSAITPTRTEKDAVNALIRERCEAVILLGSRMSPSDLETIAQQLPVQVIARGSGTPKVSSVHVDDAVGAQLALNHLIELGHEHIIYIDGGDAPGTQE

SEQ ID NO: 385 - DNA, 1503 bp, Corynebacterium glutamicum
  CDS (101)..(1480): RXN01927
gagcagcgggatcttttgcgtaattcgcgcgcgcagatccatgtgattgaccacaatggtgatgaaattttggataccccaacggaagaggatttttaagatggctttggttcttggaatcgatagttccacccaatcctgcaaggctttgcttgtcgacgccgccaccggccaggttatcgacgaaggccgcgcgagtcacccgagcgggtcggaggtagatccacgtgcgtggatcgctgcgctggatcaagctaccgaggggttgttagaacgcgcggacgctgtatctattgcaggccagcagcacggcatggtggcgttggatgaaaacgatgaaatcgttcgcccggcgttgttatggaatgacactcgttctgcccaggctgcgttggatctcaatgaggagatcggcggcgatcaggctgcggtagatgccacgggaagtgtgtatgttgcttctttaactgccaccaaaatgcggtggatgcgtgatcatgaaccagaaaatgcagcgcgcacggcgtcggtgatgttgcctcatgatttcctcacctggcatttgatgggacgcggacgcaaagtcaccgaccatggtgatgcttctggaacgggctactacagcacgcgtgatcgtgcgtggcgcaccgatctagctgccttggcgctgggccatgaggtggaacttcctgaactcctggccccaaatgcgattgcgggaacaactccaggtggagtgaaagttgctgcaggcacgggagataatgctgcggctgcgcttggccttgatttgcagcctggtgatgtcagcgtgtcgatcggcacctctggcgttgccggcatgaccgttcaacatagcgtccacgatccatctggtttggtcactggtttcgccgatgccacgggtgcgtatttcccgctggcctgcacgcttaatggcgcaccggtgttggaattcggccgccgcattctgggcgtggaatgggaagagttcgatgcgcttgcactggctgctcaacccggttcaggtggcgtgacgctccagccttatttggagggcgagcgtacgccgaatcgtcccgcagcacgtggcgttttggctggactaaactgtgcaacgacccgcgaggactttgcccgagcaactgttgaaggcttgttgttggcattggatgatgctgtaacggcgctggttgaggccacgggagtgcccgttcagcgcatccagctcatcggtggcggcgcgcgttcacaggcggttcgtgagattgcccctgagattttcggccatgagattgtggttccagaacccgctgaatatgtggcgttgggtgcagctcgtcaggcggcatgggcgctgtcgggtgaggccacgccaccgcagtggccaactcccggttccgatccgcaccgcgcacctaaaaacactgagctgagcacgcgttatgcgaagctgcgtgctgcaacgcagggttggtactagagctcgatattgtcgatcaa

SEQ ID NO: 386 - protein, 460 aa, Corynebacterium glutamicum
MALVLGIDSSTQSCKALLVDAATGQVIDEGRASHPSGSEVDPRAWIAALDQATEGLLERADAVSIAGQQHGMVALDENDEIVRPALLWNDTRSAQAALDLNEEIGGDQAAVDATGSVYVASLTATKMRWMRDHEPENAARTASVMLPHDFLTWHLMGRGRKVTDHGDASGTGYYSTRDRAWRTDLAALALGHEVELPELLAPNAIAGTTPGGVKVAAGTGDNAAAALGLDLQPGDVSVSIGTSGVAGMTVQHSVHDPSGLVTGFADATGAYFPLACTLNGAPVLEFGRRILGVEWEEFDALALAAQPGSGGVTLQPYLEGERTPNRPAARGVLAGLNCATTREDFARATVEGLLLALDDAVTALVEATGVPVQRIQLIGGGARSQAVREIAPEIFGHEIVVPEPAEYVALGAARQAAWALSGEATPPQWPTPGSDPHRAPKNTELSTRYAKLRAATQGWY

SEQ ID NO: 387 - DNA, 1139 bp, Corynebacterium glutamicum
  CDS (1)..(1116): FRXA01927
aatgacactcgttctgcccaggctgcgttggatctcaatgaggagatcggcggcgatcaggctgcggtagatgccacgggaagtgtgtatgttgcttctttaactgccaccaaaatgcggtggatgcgtgatcatgaaccagaaaatgcagcgcgcacggcgtcggtgatgttgcctcatgatttcctcacctggcatttgatgggacgcggacgcaaagtcaccgaccatggtgatgcttctggaacgggctactacagcacgcgtgatcgtgcgtggcgcaccgatctagctgccttggcgctgggccatgaggtggaacttcctgaactcctggccccaaatgcgattgcgggaacaactccaggtggagtgaaagttgctgcaggcacgggagataatgctgcggctgcgcttggccttgatttgcagcctggtgatgtcagcgtgtcgatcggcacctctggcgttgccggcatgaccgttcaacatagcgtccacgatccatctggtttggtcactggtttcgccgatgccacgggtgcgtatttcccgctggcctgcacgcttaatggcgcaccggtgttggaattcggccgccgcattctgggcgtggaatgggaagagttcgatgcgcttgcactggctgctcaacccggttcaggtggcgtgacgctccagccttatttggagggcgagcgtacgccgaatcgtcccgcagcacgtggcgttttggctggactaaactgtgcaacgacccgcgaggactttgcccgagcaactgttgaaggcttgttgttggcattggatgatgctgtaacggcgctggttgaggccacgggagtgcccgttcagcgcatccagctcatcggtggcggcgcgcgttcacaggcggttcgtgagattgcccctgagattttcggccatgagattgtggttccagaacccgctgaatatgtggcgttgggtgcagctcgtcaggcggcatgggcgctgtcgggtgaggccacgccaccgcagtggccaactcccggttccgatccgcaccgcgcacctaaaaacactgagctgagcacgcgttatgcgaagctgcgtgctgcaacgcagggttggtactagagctcgatattgtcgatcaa

SEQ ID NO: 388 - protein, 372 aa, Corynebacterium glutamicum
NDTRSAQAALDLNEEIGGDQAAVDATGSVYVASLTATKMRWMRDHEPENAARTASVMLPHDFLTWHLMGRGRKVTDHGDASGTGYYSTRDRAWRTDLAALALGHEVELPELLAPNAIAGTTPGGVKVAAGTGDNAAAALGLDLQPGDVSVSIGTSGVAGMTVQHSVHDPSGLVTGFADATGAYFPLACTLNGAPVLEFGRRILGVEWEEFDALALAAQPGSGGVTLQPYLEGERTPNRPAARGVLAGLNCATTREDFARATVEGLLLALDDAVTALVEATGVPVQRIQLIGGGARSQAVREIAPEIFGHEIVVPEPAEYVALGAARQAAWALSGEATPPQWPTPGSDPHRAPKNTELSTRYAKLRAATQGWY

SEQ ID NO: 389 - DNA, 844 bp, Corynebacterium glutamicum
  CDS (101)..(844): RXA02729
gaattaattgcaggcacggtacctagcgtgacgaaaactacgatccccactgcccttattcatcgtgaatcaatcatcaactccactttaaggaagaaggatggactccccaatgagtaactcaaccggtaccgacattgtcgttgtcggatccatcaatgccgatctcaccgcaaaagttcaacgccaccctgaacctggagaaaccctcctgggtagcggcggcacagtgagtgctggtggcaaaggcgccaaccaagctgtggcggcagcgcaattaggtgccaaagtcaccatgatcggtgcggtcggaaccgatcaaatggctggcgaggcgctgacacatttgcgtcaatcaggagcagatatgtccgcgattgccactgtggacggtcccactggtcttgccatcatcactgtgtctgacgatggggaaaacaccatcatcgttatccctggcgctaacgcttctgtcaccgcggaatttgttgataaacactcccaactcattgagaacgccggcattgtgttgcttcagggtgagatccctgccgatggtttcgagcgtgccgttgatctttcacaaggacgtgtggtgatcaatctggctccagttgtgcccgtgggacatgatcagctgcgtcgtgccgatccattgctggtcaacgaacacgaaggcgctctggtgctggacatgcttggaactccagcgaccacgtctgatccccaaagtttggtcactgaattgctggagcagggttttacttccgtggtgatgacacttggtgccgaaggtgctctggttggcacgccgggccaactcacggcaattcctaccccaaag

SEQ ID NO: 390 - protein, 248 aa, Corynebacterium glutamicum
MDSPMSNSTGTDIVVVGSINADLTAKVQRHPEPGETLLGSGGTVSAGGKGANQAVAAAQLGAKVTMIGAVGTDQMAGEALTHLRQSGADMSAIATVDGPTGLAIITVSDDGENTIIVIPGANASVTAEFVDKHSQLIENAGIVLLQGEIPADGFERAVDLSQGRVVINLAPVVPVGHDQLRRADPLLVNEHEGALVLDMLGTPATTSDPQSLVTELLEQGFTSVVMTLGAEGALVGTPGQLTAIPTPK

SEQ ID NO: 391 - DNA, 1026 bp, Corynebacterium glutamicum
  CDS (101)..(1003): RXA02797
acagtctcatgaagccataataaccaccttctacaaagatcgacgtagaatggaataaccccttatgaaaacgtttgcataactccgctaaggatgttccatgaataatcgaattgtcgtagtcggctccatcaacgctgatcttaatgttctcgttgaccgccacccagcacctggcgaaacactgttgggcagtggtggacacatcactgcaggaggcaaaggcgccaaccaggcagtagctgccgctcttcaaggtgcagacgtcgcctttgtcggcgctgtgggcaaggatccttacgctgccccagccttagaattccttcgttcgtcaggcgtcgaccttacggcagtatccgaagtagatgacaccaccgggcttgcagttatcaccgttgccaaagacggcgagaacaatatcgttgtcatccccggcgcgaattccctggtcaattgtgattatgtaagcagccaatccgctcttttagctgaagctggaatcctgttgctgcaaggtgagatccctgcggatggcttcaaagaggccattcaccacaccatgggtcgcgtcgtggtgaatctagcgcccgtcatcgaggtagagaagtccgcgttacttgaggctgatccgatcatcgccaatgagcacgaggccggcctgattctggatcaattcggggcaggcatcgattccatggatccccacgagctcgcgcaagctctcctcgacgccggtttcgcctctgttgttttaacgcttggatccgcaggcgcgttggtcgccgatgccaccggtatcacggacatcgccacaccaacggtgcaggcagttgacaccacgggagccggtgacgcttttgccggagccttctgcgcacgactaattaaaggcgattcgcttatcgacgccgccacccacgcagcacgcgtcggcgcttactcggtgcaaaccgccggagcgcaagcgtcctatccggacgcgagcgtttcacttccctctgtttaaaaaaactatttaagaagagg

SEQ ID NO: 392 - protein, 301 aa, Corynebacterium glutamicum
MNNRIVVVGSINADLNVLVDRHPAPGETLLGSGGHITAGGKGANQAVAAALQGADVAFVGAVGKDPYAAPALEFLRSSGVDLTAVSEVDDTTGLAVITVAKDGENNIVVIPGANSLVNCDYVSSQSALLAEAGILLLQGEIPADGFKEAIHHTMGRVVVNLAPVIEVEKSALLEADPIIANEHEAGLILDQFGAGIDSMDPHELAQALLDAGFASVVLTLGSAGALVADATGITDIATPTVQAVDTTGAGDAFAGAFCARLIKGDSLIDAATHAARVGAYSVQTAGAQASYPDASVSLPSV

SEQ ID NO: 393 - DNA, 1161 bp, Corynebacterium glutamicum
  CDS (101)..(1138): RXA02730
ccaacatcgccttgcacgtaataggttaaaacacaagtgaatgtaatcgtttgcagcaatcgattacataaaggtagataatgagataaagcgaggcgctatggcgacggaaaaattccgaccgactcttaaagatgtcgctcgtcaagcaggtgtctccatcgccacagcatcacgagcactagcggataatccggcggttgctgcatcgactcgtgaaagaatccaacaattagcctctgatctgggttaccgggccaatgctcaagctcgtgcgcttcgcagttctcgcagcaacaccattggtgtgattgttcccagtttgattaaccattacttcgccgcaatggttactgaaattcaaagcaccgccagcaaagctggacttgccacgattatcaccaacagcaatgaagatgcgaccactatgtctgggtctttggagtttctcacctcgcatggtgtcgatggaatcatctgcgtacctaatgaggaatgcgcgaatcaactagaggacttgcagaagcaaggaatgccagtggtgttggttgaccgagagcttccaggagactccaccatcccaacggcgacctctaacccccaaccaggaatcgccgcagcagtagaactcctggctcacaacaacgcgttgccgattggttacctctcaggtcccatggacacctcaacaggtagagagcgattagaggatttcaaagcagcctgcgccaactccaaaattggcgaacagctcgtttttctgggtgggtacgaacaaagcgttggatttgaaggcgctacgaaattgctcgatcaaggagctaaaactctttttgccggcgattctatgatgacgatcggtgtcattgaagcctgccataaggctggtttggttatcggcaaggatgtcagcgtgattggttttgatacacatccgctttttgccctgcaacctcatccgttgacagtgattgatcaaaatgtagaacaactagcccaacgagcagtgtctatcctcaccgaattaattgcaggcacggtacctagcgtgacgaaaactacgatccccactgcccttattcatcgtgaatcaatcatcaactccactttaaggaagaaggatggactccccaatgagtaactcaaccggtaccgacattg

SEQ ID NO: 394 - protein, 346 aa, Corynebacterium glutamicum
MATEKFRPTLKDVARQAGVSIATASRALADNPAVAASTRERIQQLASDLGYRANAQARALRSSRSNTIGVIVPSLINHYFAAMVTEIQSTASKAGLATIITNSNEDATTMSGSLEFLTSHGVDGIICVPNEECANQLEDLQKQGMPVVLVDRELPGDSTIPTATSNPQPGIAAAVELLAHNNALPIGYLSGPMDTSTGRERLEDFKAACANSKIGEQLVFLGGYEQSVGFEGATKLLDQGAKTLFAGDSMMTIGVIEACHKAGLVIGKDVSVIGFDTHPLFALQPHPLTVIDQNVEQLAQRAVSILTELIAGTVPSVTKTTIPTALIHRESIINSTLRKKDGLPNE

SEQ ID NO: 395 - DNA, 483 bp, Corynebacterium glutamicum
  CDS (101)..(460): RXA02551
gctgcacaaattccgcgaaagggtatcaccatcgacatcacagatgaagaccgtgagatcttaaaaaaacaccgtcgatttcatttccttctcctattacatgtccgtatgtgaagcccacaaccccgaaaactactcaaccggtggcggtaacatcatcggcggagtggtcagccccactctcgcggcttccgaatggggttggcaagttgatcccctcggtttgcgcatcgtcctgaacaactactgggagcgctggcagaagccactgttcatcgtcgaaaacggactaggagcaaaggacgtgcttatcgacggaccctccggcccaacagtaaacgatgactaccgcatcaaatacctcgacgacggcggctcaggaatcttgaagcgctacaagaagaagtcctttgattggtgccgcgacatcatcgccaccaatggcgaaagcctggaatcctaagaaataaaggtaggtgtcac

SEQ ID NO: 396 - protein, 120 aa, Corynebacterium glutamicum
MSVCEAHNPENYSTGGGNIIGGVVSPTLAASEWGWQVDPLGLRIVLNNYWERWQKPLFIVENGLGAKDVLIDGPSGPTVNDDYRIKYLDDGGSGILKRYKKKSFDWCRDIIATNGESLES

SEQ ID NO: 397 - DNA, 795 bp, Corynebacterium glutamicum
  CDS (101)..(772): RXA01325
gcgcagcgctcggacgattacgaacttcaggagaactcggggtcattcgttgcattctaccctggaaattttcccacactaagtcaggtctaagtagggtatggatatgacgatttcccgctccaccatggcccaaatccttgactacaccctcctcggaccagaagtaaccaactccgaactggccgcatttatagattccgcaattgagctgggagtcggcacgatctgtgtccccaacagcatggtcaacctaactgcaaaagcccaagaagctggaattcgagtggccaccgtcgcaggattcccgcacggcaaaacccccgcgttggtgaaagccgccgaagcgcgccttgccgtacagtccggagcttccgaagtagatgttgttttggatattgcggtagtgaaagagggagatgccaataggttgctgcaggaaattgtggcaatcagggaggctgttccatctcctgtggtgctgaaattcatcctcgaaacagctgttgtgagtgatgaagcaattgtgactgcagtgaatgcgttgattgctgctggtgctgacttcgctaaaacttccacgggattccacccagcgggaggggcaactgttgaggctgttcgggtgatggcttcggcttctcggggaagggttggaattaaggctgccggtggggtgaaaacttgggaagatgcggtggcgtttgttgaagcaggggctactcgcattggaacttctaatgcgggagccattttggagggtgcgccggagtagtttggcgttctaatcgggac

SEQ ID NO: 398 - protein, 224 aa, Corynebacterium glutamicum
MDMTISRSTMAQILDYTLLGPEVTNSELAAFIDSAIELGVGTICVPNSMVNLTAKAQEAGIRVATVAGFPHGKTPALVKAAEARLAVQSGASEVDVVLDIAVVKEGDANRLLQEIVAIREAVPSPVVLKFILETAVVSDEAIVTAVNALIAAGADFAKTSTGFHPAGGATVEAVRVMASASRGRVGIKAAGGVKTWEDAVAFVEAGATRIGTSNAGAILEGAPE

SEQ ID NO: 399 - DNA, 684 bp, Corynebacterium glutamicum
  CDS (101)..(661): RXA00195
tcgcagtcatcatgcaggcataacctgaaacccatccgtttggattgccccaaatgggtgtagtgggtgcgtttacccaacaagtgcaagaatgggagtcgtgactaaaaagatccttattttgggaagcactggttcgattggaactcaggcgctggacgttattgctgataattcagacaagtttgaggtggtgggtatcgctgcgggcggttctcagccagacctcgttatttcgcaggcgcagcagttggggctggctgcagacaaggttgcggttgctgatgcacaggctgccgcagtaatttcgaaggctctcggcggcgagatcatctctggaaccgatgctgcgaagattctggtggaaaccacaaaggccgacactgtgcttaatgctctggttggttctttggggcttgcggcaacgctggccactctggaatctggtgcgcatcttgccttggctaacaaagaatcgctggttgccggtggtgagtttgttacctcaaaggcaaagctggggcagatcattccggtcgattcggagcactctgccatggcgcagtgtttgcgttcgggtactcgtgatgaggttgcgcggattgtgctgacagcttcgggcggacctttcagggctggaccagggagaagatgtgggaggtgactcccgagcaggcagcagcg

SEQ ID NO: 400 - protein, 187 aa, Corynebacterium glutamicum
VTKKILILGSTGSIGTQALDVIADNSDKFEVVGIAAGGSQPDLVISQAQQLGLAADKVAVADAQAAAVISKALGGEIISGTDAAKILVETTKADTVLNALVGSLGLAATLATLESGAHLALANKESLVAGGEFVTSKAKLGQIIPVDSEHSAMAQCLRSGTRDEVARIVLTASGGPFRAGPGRRCGR

SEQ ID NO: 401 - DNA, 738 bp, Corynebacterium glutamicum
  CDS (101)..(715): RXA00196
ctgccatggcgcagtgtttgcgttcgggtactcgtgatgaggttgcgcggattgtgctgacagcttcgggcggacctttcagggctggaccagggagaagatgtgggaggtgactcccgagcaggcagcagcgcacccaacgtgggcgatggggcagatgaacacgttgaactccgccacccttattaataaaggcctcgaactcatcgaggcgaccctgctgtttgaaacggatgcggatctcattgatgtgacggtgcatccgcagtcgatcatccactccatgatcacgtttacggatggtgcgaccatcgcgcaggcgtcgccaccatcgatgaaactgccgatcgcgttggcgcttgattggccacatcgggtgccgaaggctcagccggcgctggatttcaccgctgctcatacctgggcttttgagccggtggatgatgccgcattccctgcggtgcagctggctaggcacgtcgcaaagcaaaaaggcacgtaccccgcggtgtataacgccgccaacgaggaggcggctgaggcgtttttgcgcgggcgaatcaagtttccgcagatcgtggacgtggtggacgaggtcctccaaggagcttctcagtttgctggtgtagcatcacacgtcgatgatattttggcaaccgaatctgaggcacgcgcgcgtgcgaatgctttgatcaaccggttggcaaccaacttgtaagctaaggagcttccgcctcg

SEQ ID NO: 402 - protein, 205 aa, Corynebacterium glutamicum
MWEVTPEQAAAHPTWAMGQMNTLNSATLINKGLELIEATLLFETDADLIDVTVHPQSIIHSMITFTDGATIAQASPPSMKLPIALALDWPHRVPKAQPALDFTAAHTWAFEPVDDAAFPAVQLARHVAKQKGTYPAVYNAANEEAAEAFLRGRIKFPQIVDVVDEVLQGASQFAGVASHVDDILATESEARARANALINRLATNL

SEQ ID NO: 403 - DNA, 2031 bp, Corynebacterium glutamicum
  CDS (101)..(2008): RXN01562
gcaggtgcacatttgttttgtcacctgcacaaaagtgtcgccagcccgatacttgtacaaccgtccgcatccgagaagcaaaggtgtctgactcgcgccaatgggaattctgaacagtatttcaacacctgctgacttaaaggcccttaatgatgaggatttggacgctcttgccaaagaaatccgaactttcctggtcgataaagtcgcagcaactggtggccacttaggtccaaatttgggcgtagtggaattaaccatcggtcttcatcgagttttcgattcgcctcaagacccgatcatctttgatacttctcaccagtcctatgtgcataagatcctgacgggtcgcgctaaagattttgattctttgcgtcaaaaagatggcctttctggttacacctgccgtgctgaaagtgagcacgattggactgagtcttcgcatgcttcggcggccttgtcttatgcggatggtttgtctaaagccaagcagttggatggcgataccacgcatagtgtggttgctgtcgttggtgatggcgctctaactggcggcatgtgttgggaagcactgaacaatattgctgctggtaaagaccgcaaagttgttgtcgtagtcaatgacaatggccggagttattctccaaccattggcggatttgcggaaaaccttgcgggccttcgcatgcagcctttctatgatcgcttcatggaaaagggcaagacgtccctgaaatccatggggtgggtaggggagcgtacttttgaagcgctccatgcatttaaagaaggtgtgaagagcaccgtcattcccaccgaaatgttccctgaactgggcatgaaatacgtgggtccggttgatggacataaccaaaaagctgtcgacaatgcgctgaaatacgctcatgattatgatggccccatcatcgtgcacatggtcaccgaaaagggtcgtggttacgcgcctgctgagcaggatttggacgaattgatgcactccacgggcgtcatcgatccgctcacaggagctcctaaatctgcatcaaagcccggttggacctctgtgttcagcgatgagctggtcaagattggtgcgcagaatgaaaacgttgttgccatcaccgccgcgatggcaggtcctaccggtctgtccaagttcgaagccaatttccccaaccgattctttgatgtcggcattgctgagcagcacgcggtaacttctgccgcaggcctcgcattgggtggaaaacaccctgtggtggctatttactccacgttcttgaaccgcgcttttgatcagctgctcatggatgtgggcatgctcaaccagcctgttactttggtgcttgatcgctcaggtgtcacgggttcggatggagcgagccacaatggcgtctgggatatggcgctgacctcgatcgttccaggcgtgcaggtggcggcaccacgtgatgaggattccttgcgtgagctgctcaatgaggctatttccatcgatgatggccccacagttgtgcgtttccccaagggcgacttgccaactccaattgttgctatcgacaccttggaagacggcgtggatgtcctcgcatatgaagacgccactgacgttgaatcaaccgacgatgcgccatcagttctcatcattgcggtaggcgagcgcgcaactgttgcacttgacgttgcttccaggattaaacagcacggcgtgaacgtcacggttgttgacccccgctggattgtccccatcccgcagtccttggtcgcgctgtctgatgatcatgacctcgtgatcaccatcgaagacggcgtcatccacggcggcgtgggatccttgctctctgatgcgcttaacgcctctgaggtggatacccctcgccgacaaatcgccgtgccccagaagtacctggatcacgcgtcccgcaatgaagtgctcgccgattatggcctcgacgccgacggcattgaaaccactgttgttggatggctggattccctgttcggggaataaaaccctgcttatcgacgccg

SEQ ID NO: 404 - protein, 636 aa, Corynebacterium glutamicum
MGILNSISTPADLKALNDEDLDALAKEIRTFLVDKVAATGGHLGPNLGVVELTIGLHRVFDSPQDPIIFDTSHQSYVHKILTGRAKDFDSLRQKDGLSGYTCRAESEHDWTESSHASAALSYADGLSKAKQLDGDTTHSVVAVVGDGALTGGMCWEALNNIAAGKDRKVVVVVNDNGRSYSPTIGGFAENLAGLRMQPFYDRFMEKGKTSLKSMGWVGERTFEALHAFKEGVKSTVIPTEMFPELGMKYVGPVDGHNQKAVDNALKYAHDYDGPIIVHMVTEKGRGYAPAEQDLDELMHSTGVIDPLTGAPKSASKPGWTSVFSDELVKIGAQNENVVAITAAMAGPTGLSKFEANFPNRFFDVGIAEQHAVTSAAGLALGGKHPVVAIYSTFLNRAFDQLLMDVGMLNQPVTLVLDRSGVTGSDGASHNGVWDMALTSIVPGVQVAAPRDEDSLRELLNEAISIDDGPTVVRFPKGDLPTPIVAIDTLEDGVDVLAYEDATDVESTDDAPSVLIIAVGERATVALDVASRIKQHGVNVTVVDPRWIVPIPQSLVALSDDHDLVITIEDGVIHGGVGSLLSDALNASEVDTPRRQIAVPQKYLDHASRNEVLADYGLDADGIETTVVGWLDSLFGE

SEQ ID NO: 405 - DNA, 1061 bp, Corynebacterium glutamicum
  CDS (1)..(1038): FRXA01562
gagcaggatttggacgaattgatgcactccacgggcgtcatcgatccgctcacaggagctcctaaatctgcatcaaagcccggttggacctctgtgttcagcgatgagctggtcaagattggtgcgcagaatgaaaacgttgttgccatcaccgccgcgatggcaggtcctaccggtctgtccaagttcgaagccaatttccccaaccgattctttgatgtcggcattgctgagcagcacgcggtaacttctgccgcaggcctcgcattgggtggaaaacaccctgtggtggctatttactccacgttcttgaaccgcgcttttgatcagctgctcatggatgtgggcatgctcaaccagcctgttactttggtgcttgatcgctcaggtgtcacgggttcggatggagcgagccacaatggcgtctgggatatggcgctgacctcgatcgttccaggcgtgcaggtggcggcaccacgtgatgaggattccttgcgtgagctgctcaatgaggctatttccatcgatgatggccccacagttgtgcgtttccccaagggcgacttgccaactccaattgttgctatcgacaccttggaagacggcgtggatgtcctcgcatatgaagacgccactgacgttgaatcaaccgacgatgcgccatcagttctcatcattgcggtaggcgagcgcgcaactgttgcacttgacgttgcttccaggattaaacagcacggcgtgaacgtcacggttgttgacccccgctggattgtccccatcccgcagtccttggtcgcgctgtctgatgatcatgacctcgtgatcaccatcgaagacggcgtcatccacggcggcgtgggatccttgctctctgatgcgcttaacgcctctgaggtggatacccctcgccgacaaatcgccgtgccccagaagtacctggatcacgcgtcccgcaatgaagtgctcgccgattatggcctcgacgccgacggcattgaaaccactgttgttggatggctggattccctgttcggggaataaaaccctgcttatcgacgccg

SEQ ID NO: 406 - protein, 346 aa, Corynebacterium glutamicum
EQDLDELMHSTGVIDPLTGAPKSASKPGWTSVFSDELVKIGAQNENVVAITAAMAGPTGLSKFEANFPNRFFDVGIAEQHAVTSAAGLALGGKHPVVAIYSTFLNRAFDQLLMDVGMLNQPVTLVLDRSGVTGSDGASHNGVWDMALTSIVPGVQVAAPRDEDSLRELLNEAISIDDGPTVVRFPKGDLPTPIVAIDTLEDGVDVLAYEDATDVESTDDAPSVLIIAVGERATVALDVASRIKQHGVNVTVVDPRWIVPIPQSLVALSDDHDLVITIEDGVIHGGVGSLLSDALNASEVDTPRRQIAVPQKYLDHASRNEVLADYGLDADGIETTVVGWLDSLFGE

SEQ ID NO: 407 - DNA, 703 bp, Corynebacterium glutamicum
  CDS (101)..(703): FRXA01705
gcaggtgcacatttgttttgtcacctgcacaaaagtgtcgccagcccgatacttgtacaaccgtccgcatccgagaagcaaaggtgtctgactcgcgccaatgggaattctgaacagtatttcaacacctgctgacttaaaggcccttaatgatgaggatttggacgctcttgccaaagaaatccgaactttcctggtcgataaagtcgcagcaactggtggccacttaggtccaaatttgggcgtagtggaattaaccatcggtcttcatcgagttttcgattcgcctcaagacccgatcatctttgatacttctcaccagtcctatgtgcataagatcctgacgggtcgcgctaaagattttgattctttgcgtcaaaaagatggcctttctggttacacctgccgtgctgaaagtgagcacgattggactgagtcttcgcatgcttcggcggccttgtcttatgcggatggtttgtctaaagccaagcagttggatggcgataccacgcatagtgtggttgctgtcgttggtgatggcgctctaactggcggcatgtgttgggaagcactgaacaatattgctgctggtaaagaccgcaaagttgttgtcgtagtcaatgacaatggccggagttattctccaaccattggcggatttgcggaaaaccttgcgggccttcgcatgcagcctttctatgat

SEQ ID NO: 408 - protein, 201 aa, Corynebacterium glutamicum
MGILNSISTPADLKALNDEDLDALAKEIRTFLVDKVAATGGHLGPNLGVVELTIGLHRVFDSPQDPIIFDTSHQSYVHKILTGRAKDFDSLRQKDGLSGYTCRAESEHDWTESSHASAALSYADGLSKAKQLDGDTTHSVVAVVGDGALTGGMCWEALNNIAAGKDRKVVVVVNDNGRSYSPTIGGFAENLAGLRMQPFYD

SEQ ID NO: 409 - DNA, 2241 bp, Corynebacterium glutamicum
  CDS (101)..(2218): RXN00879
caccccaaagcccaatccaaaagatgtattttctaacaaacttaccctcacgctacaaatatgctgtgcccacacgctattagtggcataatgttgtgttgtgactgctcgcagatttttgaatgaactcgccgatctctacggcgtagcaacttcctacactgattacaaaggtgcccatattgaggtcagcgatgacacattagtgaaaatcctgcgtgctctgggtgtgaatttagatacaagcaacctccccaacgatgacgctatccaacgccaaattgccctcttccatgatcgagagttcactcgcccactgcctccatcggtggttgcagttgaaggtgatgaactagttttcccggtgcatgtgcacgacggttcccctgcagatgtccacatcgaattggaagacggcacgcagcgggatgtttctcaggtggaaaactggacagcgccacgggaaattgatgggattaggtggggcgaggcatcgtttaagattcctggtgatctccccttgggttggcacaagcttcaccttaaatccaatgaacgctcagctgagtgcggtttgatcatcaccccggctcgtctgtctactgctgataagtatcttgattcccctcgcagtggtgtcatggcgcagatctactctgtgcgttccacgttgtcgtggggcatgggtgatttcaatgatttaggaaacttggcaagtgtggttgcccaggatggagcagacttcctgctcatcaaccccatgcacgctgcagagccgctgcctcctactgaggactctccttatctgcccacaaccaggcgctttatcaacccgatctacattcgggtagaagatattccggagtttaatcagcttgagattgatctacgcgatgatatcgcagagatggctgcggaattccgcgaacgcaatctgacctcagacatcattgagcgcaatgacgtctacgctgcaaagcttcaagtgctgcgcgccatttttgaaatgcctcgttccagcgaacgtgaagccaactttgtctccttcgtgcaacgggaaggccaaggtcttattgatttcgccacctggtgcgcggaccgcgaaactgcacagtctgaatctgtccacggaactgagccagaccgcgatgagctgaccatgttctacatgtggttgcagtggctatgtgatgagcagctggcggcagctcaaaagcgcgctgtcgatgccggaatgtcgatcggcatcatggcagacctggcagttggtgtgcatccaggtggtgctgatgcccagaacctcagccacgtacttgctccggatgcgtcagtgggcgccccaccagatggatacaaccagcagggccaagactggtcccagccaccatggcatccagtgcgtcttgcagaggaaggctacattccgtggcgtaatctgctgcgcactgtgctgcgtcactccggcggaatccgcgtggaccacgttcttggtttgttcaggctctttgtcatgccacgcatgcaatcccctgctacgggcacctatatccgcttcgaccataatgcgttggtaggcattctagccctagaagcagaactcgcaggcgccgttgtcattggtgaagatctgggaacgtttgagccttgggtacaagatgcattggctcagcgtggcatcatgggcacctcgatcctatggttcgagcattccccaagccagccgggtcctcgccgccaggaagagtatcgtccgctggccttgaccactgtgaccactcatgatctccctccgactgctggttatttggagggcgagcacattgctcttcgtgagcgattgggggtgctcaacactgatcctgctgcagaactcgctgaggatctgcagtggcaagcggagatccttgatgtcgcagcatctgccaacgcattgccagcccgggaatacgtgggactcgaacgcgatcagcgcggtgagttggctgagctgttggaaggcctgcacactttcgttgcgaaaaccccttcagcactgacctgtgtctgcttggtagacatggtcggtgaaaagcgggcacagaatcagccgggcacaacgagggatatgtatcccaactggtgtatcccactgtgtgacagcgaaggcaactccgtgctcattgaatcgctgcgtgaaaatgagctgtatcaccgtgtggcaaaggcaagcaagcgagattaggtccgcttcagttgtggtgg

SEQ ID NO: 410 - protein, 706 aa, Corynebacterium glutamicum
VTARRFLNELADLYGVATSYTDYKGAHIEVSDDTLVKILRALGVNLDTSNLPNDDAIQRQIALFHDREFTRPLPPSVVAVEGDELVFPVHVHDGSPADVHIELEDGTQRDVSQVENWTAPREIDGIRWGEASFKIPGDLPLGWHKLHLKSNERSAECGLIITPARLSTADKYLDSPRSGVMAQIYSVRSTLSWGMGDFNDLGNLASVVAQDGADFLLINPMHAAEPLPPTEDSPYLPTTRRFINPIYIRVEDIPEFNQLEIDLRDDIAEMAAEFRERNLTSDIIERNDVYAAKLQVLRAIFEMPRSSEREANFVSFVQREGQGLIDFATWCADRETAQSESVHGTEPDRDELTMFYMWLQWLCDEQLAAAQKRAVDAGMSIGIMADLAVGVHPGGADAQNLSHVLAPDASVGAPPDGYNQQGQDWSQPPWHPVRLAEEGYIPWRNLLRTVLRHSGGIRVDHVLGLFRLFVMPRMQSPATGTYIRFDHNALVGILALEAELAGAVVIGEDLGTFEPWVQDALAQRGIMGTSILWFEHSPSQPGPRRQEEYRPLALTTVTTHDLPPTAGYLEGEHIALRERLGVLNTDPAAELAEDLQWQAEILDVAASANALPAREYVGLERDQRGELAELLEGLHTFVAKTPSALTCVCLVDMVGEKRAQNQPGTTRDMYPNWCIPLCDSEGNSVLIESLRENELYHRVAKASKRD

SEQ ID NO: 411 - DNA, 2223 bp, Corynebacterium glutamicum
  CDS (101)..(2200): FRXA00879
aaaagatgtattttctaacaaacttaccctcacgctacaaatatgctgtgcccacacgctattagtggcataatgttgtgttgtgactgctcgcagatttttgaatgaactcgccgatctctacggcgtagcaacttcctacactgattacaaaggtgcccatattgaggtcagcgatgacacattagtgaaaatcctgcgtgctctgggtgtgaatttagatacaagcaacctccccaacgatgacgctatccaacgccaaattgccctcttccatgatcgagagttcactcgcccactgcctccatcggtggttgcagttgaaggtgatgaactagttttcccggtgcatgtgcacgacggttcccctgcagatgtccacatcgaattggaagacggcacgcagcgggatgtttctcaggtggaaaactggacagcgccacgggaaattgatgggattaggtggggcgaggcatcgtttaagattcctggtgatctccccttgggttggcacaagcttcaccttaaatccaatgaacgctcagctgagtgcggtttgatcatcaccccggctcgtctgtctactgctgataagtatcttgattcccctcgcagtggtgtcatggcgcagatctactctgtgcgttccacgttgtcgtggggcatgggtgatttcaatgatttaggaaacttggcaagtgtggttgcccaggatggagcagacttcctgctcatcaaccccatgcacgctgcagagccgctgcctcctactgaggactctccttatctgcccacaaccaggcgctttatcaacccgatctacattcgggtagaagatattccggagtttaatcagcttgagattgatctacgcgatgatatcgcagagatggctgcggaattccgcgaacgcaatctgacctcagacatcattgagcgcaatgacgtctacgctgcaaagcttcaagtgctgcgcgccatttttgaaatgcctcgttccagcgaacgtgaagccaactttgtctccttcgtgcaacgggaaggccaaggtcttattgatttcgccacctggtgcgcggaccgcgaaactgcacagtctgaatctgtccacggaactgagccagaccgcgatgagctgaccatgttctacatgtggttgcagtggctatgtgatgagcagctggcggcagctcaaaagcgcgctgtcgatgccggaatgtcgatcggcatcatggcagacctggcagttggtgtgcatccaggtggtgctgatgcccagaacctcagccacgtacttgctccggatgcgtcagtgggcgccccaccagatggatacaaccagcagggccaagactggtcccagccaccatggcatccagtgcgtcttgcagaggaaggctacattccgtggcgtaatctgctgcgcactgtgctgcgtcactccggcggaatccgcgtggaccacgttcttggtttgttcaggctctttgtcatgccacgcatgcaatcccctgctacgggcacctatatccgcttcgaccataatgcgttggtaggcattctagccctagaagcagaactcgcaggcgccgttgtcattggtgaagatctgggaacgtttgagccttgggtacaagatgcattggctcagcgtggcatcatgggcacctcgatcctatggttcgagcattccccaagccagccgggtcctcgccgccaggaagagtatcgtccgctggccttgaccactgtgaccactcatgatctccctccgactgctggttatttggagggcgagcacattgctcttcgtgagcgattgggggtgctcaacactgatcctgctgcagaactcgctgaggatctgcagtggcaagcggagatccttgatgtcgcagcatctgccaacgcattgccagcccgggaatacgtgggactcgaacgcgatcagcgcggtgagttggctgagctgttggaaggcctgcacactttcgttgcgaaaaccccttcagcactgacctgtgtctgcttggtagacatggtcggtgaaaagcgggcacagaatcagccgggcacaacgagggatatgtatcccaactggtgtatcccactgtgtgacagcgaaggcaactccgtgctcattgaatcgctgcgtgaaaatgagctgtatcaccgtgtggcaaaggcaagcaagcgagattaggtccgcttcagttgtggtgg

SEQ ID NO: 412 - protein, 700 aa, Corynebacterium glutamicum
LNELADLYGVATSYTDYKGAHIEVSDDTLVKILRALGVNLDTSNLPNDDAIQRQIALFHDREFTRPLPPSVVAVEGDELVFPVHVHDGSPADVHIELEDGTQRDVSQVENWTAPREIDGIRWGEASFKIPGDLPLGWHKLHLKSNERSAECGLIITPARLSTADKYLDSPRSGVMAQIYSVRSTLSWGMGDFNDLGNLASVVAQDGADFLLINPMHAAEPLPPTEDSPYLPTTRRFINPIYIRVEDIPEFNQLEIDLRDDIAEMAAEFRERNLTSDIIERNDVYAAKLQVLRAIFEMPRSSEREANFVSFVQREGQGLIDFATWCADRETAQSESVHGTEPDRDELTMFYMWLQWLCDEQLAAAQKRAVDAGMSIGIMADLAVGVHPGGADAQNLSHVLAPDASVGAPPDGYNQQGQDWSQPPWHPVRLAEEGYIPWRNLLRTVLRHSGGIRVDHVLGLFRLFVMPRMQSPATGTYIRFDHNALVGILALEAELAGAVVIGEDLGTFEPWVQDALAQRGIMGTSILWFEHSPSQPGPRRQEEYRPLALTTVTTHDLPPTAGYLEGEHIALRERLGVLNTDPAAELAEDLQWQAEILDVAASANALPAREYVGLERDQRGELAELLEGLHTFVAKTPSALTCVCLVDMVGEKRAQNQPGTTRDMYPNWCIPLCDSEGNSVLIESLRENELYHRVAKASKRD

SEQ ID NO: 413 - DNA, 1287 bp, Corynebacterium glutamicum
  CDS (101)..(1264): RXN00043
aacagcaggcctcaagtccgaagataattaacctaaatccgtagacataagacatcatacgtcctatgcttgctggaaggaagcaaataacctcagaaagatggcagaagtggtgcattatcaagaaaatgcaggtcaagcagttaaaaaaattgaaggaagaattgttaccccccacggggtgattgatggctttctccaactcgaaaacggcatcatcacggaactctctggagaaccagcacctaaaaacgcaggattccaccccgaactccccacgattgttcccagttttattgatcttcataatcacggtggaaacggtggcgcgtttcctacgggaacgcaggaccaggcgaggaatgccgcgcagtatcaccgcgaacatggcacgaccgtgatgttggcaagcatggtttcggcgccggctgacgcactggcagcgcaggtggaaaaccttattcccttgtgtgaagagggcctgctgtgcggcattcacctcgagggtcctttcatcaacgcatgccgttgtggtgctcaaaacccggattttatttttcccggcaacccaacagatcttgcccaggtgatccatgcgggaaaaggttggatcaaatcgatcacagtagcgccggaaactgacaatcttactgagcttctcgatctctgcgcagcgcaccacatcattgcttccttcgggcacactgatgcagattttgataccactaccagcgcaattgccttggctaaagagaaaaatgtgacggtcacggctacgcatttgttcaatgcgatgcctccgctgcatcatagggatcccggcagcgtgggcgctttgcttgctgcggcacgtgccggggacgcatatgttgagttgatcgccgacggcgtgcatttggccgatggaacggtcgatctagctcgttccaacaacgcctttttcatcacggacgccatggaagccgccggaatgccagacggtgagtacattttgggcgttttgaacgtcaccgtcaccgatggcgtcgcccgtctgcgcgatggcggcgccatcgccgggggtaccagcacactagcgagtcagttcgtgcaccacgtgcgcaggggtatgacgcttatcgacgcgaccctccacacctcaaccgtcgccgccaaaattctcggacttagcgatcacgaaatcgttaaatccaaccctgtaaattttgtggtctttgactcaaacggccagttacaacaggtccatttagaccatcaagtaatttaaatacgagcaaaactttcctg

SEQ ID NO: 414 - protein, 388 aa, Corynebacterium glutamicum
MAEVVHYQENAGQAVKKIEGRIVTPHGVIDGFLQLENGIITELSGEPAPKNAGFHPELPTIVPSFIDLHNHGGNGGAFPTGTQDQARNAAQYHREHGTTVMLASMVSAPADALAAQVENLIPLCEEGLLCGIHLEGPFINACRCGAQNPDFIFPGNPTDLAQVIHAGKGWIKSITVAPETDNLTELLDLCAAHHIIASFGHTDADFDTTTSAIALAKEKNVTVTATHLFNAMPPLHHRDPGSVGALLAAARAGDAYVELIADGVHLADGTVDLARSNNAFFITDAMEAAGMPDGEYILGVLNVTVTDGVARLRDGGAIAGGTSTLASQFVHHVRRGMTLIDATLHTSTVAAKILGLSDHEIVKSNPVNFVVFDSNGQLQQVHLDHQVI

SEQ ID NO: 415 - DNA, 1287 bp, Corynebacterium glutamicum; identical to SEQ ID NO: 413
  CDS (101)..(1264): FRXA00043

SEQ ID NO: 416 - protein, 388 aa, Corynebacterium glutamicum; identical to SEQ ID NO: 414

SEQ ID NO: 417 - DNA, 1584 bp, Corynebacterium glutamicum
  CDS (101)..(1561): RXN01752
gaaatgacgtgaccatcgataccaatacccaattgaaagatcttgacctggtcagccaagttggccgtcagatcgtggcagaacaacaggtggggaggtcatgatggaacaagatctcagctaccgtgaaattcttcccctcaacgcgagtgaggagaagaaaaaggctgcactgattgatgccattgaagggttaagggtgcgcgatccgctactctctgcctcgattgcatttactagagggcagaaagtcgccttcattgctgtggtggtgggctttatcttgatgctcatttttgctcggcaagcagcacttattggactgtcagcaacgtgtacgttcatgtacctcattacattgttggacagatttatcatgttttccagaggtatccgcgcggaatccatcatccaggtatcggatgaagatgcgctggctttccctgaggacaagctgaaaacctacacggtgttggtgcccgcctatggcgaacctgaggtgattgcgcagctgctggcatccatgcacgcttttgattaccccaagcatcttctgcaggtattgctcatgttggaggaagatgatctgcccacgatcgccgcggcagaggcagcgggagtggatcaggtggcaacgatcattaaggtgccgccagcgcagccccgcaccaagccgaaggcctgtaactatggattgcactttgccacgggggaaattgtcacgatctttgacgcggaagacatgccagatcccctccaactgcgtcgcgtggtggtggcatttgaacgctcggcttccaatacggtgtgcgtccagtcaaggttgtcgtatcgaaacgccaggcagaatctgctaactgcgtggttcaccattgaatatgacgtgtggtttaacttcctgctgccaggcgtcatgcgcatgaacgcacctgtcccattgggcggtacctccaaccatctgctcacgggtgtcctgaaagatctcggcgcgtgggatcctttcaatgtcacagaaaatgccgacctcggcgtacccatcgcggcaaaaggatattccaccgcggtgttggattcggtgacgtgggaggaagcaaactccgacaccatcaactggttgcgccagcgttctcgctggtacaagggctatctgcaaacatggcttgtgtatatgcgcaggccaaagtggttagtccaagagcttggcatcattcctgctgtgcgttttaccttcctcatggcaggcaccccgatcattgcggtgctcaatctgctcttttggtacttgtcgctcacgtggattctgggccagcccggcaccattgagcagatgttcccacctgcggtgtactacccagcgttggtgtgtttggtggtggccaatgctgcgaccatctttatgaatctcattggctgccgggaaggccgcgaccccttgctgctcatcgcggttctcacgttcccgctgtattggctgctcatgagcattgcagcgttgaaaggcacgtggcaattgatcacgcgaccatcctattgggagaaaactgcccacggattggaggcgtaagcggtgcccatcgtcaaacc

SEQ ID NO: 418 - protein, 487 aa, Corynebacterium glutamicum
MMEQDLSYREILPLNASEEKKKAALIDAIEGLRVRDPLLSASIAFTRGQKVAFIAVVVGFILMLIFARQAALIGLSATCTFMYLITLLDRFIMFSRGIRAESIIQVSDEDALAFPEDKLKTYTVLVPAYGEPEVIAQLLASMHAFDYPKHLLQVLLMLEEDDLPTIAAAEAAGVDQVATIIKVPPAQPRTKPKACNYGLHFATGEIVTIFDAEDMPDPLQLRRVVVAFERSASNTVCVQSRLSYRNARQNLLTAWFTIEYDVWFNFLLPGVMRMNAPVPLGGTSNHLLTGVLKDLGAWDPFNVTENADLGVPIAAKGYSTAVLDSVTWEEANSDTINWLRQRSRWYKGYLQTWLVYMRRPKWLVQELGIIPAVRFTFLMAGTPIIAVLNLLFWYLSLTWILGQPGTIEQMFPPAVYYPALVCLVVANAATIFMNLIGCREGRDPLLLIAVLTFPLYWLLMSIAALKGTWQLITRPSYWEKTAHGLEA

SEQ ID NO: 419 - DNA, 689 bp, Corynebacterium glutamicum
  CDS (19)..(666): FRXA01839
ttcctgctgccaggtgtcatgcgcatgaacgcacctgtcccattgggcggtacctccaaccatctgctcacgggtgtcctgaaagatctcggcgcgtgggatcctttcaatgtcacagaagatgcggacctcggcgtacgcatcgcggcaaagggatattccaccgcggtgttggattcggtgacgtgggaggaagcaaactccgacaccatcaactggttgcgccagcgttctcgctggtacaagggctatctgcaaacatggcttgtgtatatgcgcaggccaaagtggttagtccaagagcttggcatcattcctgctgtgcgttttaccttcctcatggcaggcaccccgatcattgcggtgctcaatctgctcttttggtacttgtcgctcacgtggattctgggccagcccggcaccattgagcagatgttcccacctgcggtgtactacccagcgttggtgtgtttggtggtggccaatgctgcgaccatctttatgaatctcattggctgccgggaaggccgcgaccccttgctgctcatcgcggttctcacgttcccgctgtattggctgctcatgagcattgcagcgttgaaaggcacgtggcaattgatcacgcgaccatcctattgggagaaaactgcccacggattggaggcgtaagcggtgcccatcgtcaaacc

SEQ ID NO: 420 - protein, 216 aa, Corynebacterium glutamicum
MRMNAPVPLGGTSNHLLTGVLKDLGAWDPFNVTEDADLGVRIAAKGYSTAVLDSVTWEEANSDTINWLRQRSRWYKGYLQTWLVYMRRPKWLVQELGIIPAVRFTFLMAGTPIIAVLNLLFWYLSLTWILGQPGTIEQMFPPAVYYPALVCLVVANAATIFMNLIGCREGRDPLLLIAVLTFPLYWLLMSIAALKGTWQLITRPSYWEKTAHGLEA

SEQ ID NO: 421 - DNA, 1050 bp, Corynebacterium glutamicum
  CDS (101)..(1027): RXA01859
tacgcccagggtttccatattggtaaatctaagccgattgatgaatttatagctacttatctcgagacgaaccaaaccgctacctgggggtaggaagaatatgaaaaagaagagctttccaatcgcaagagtcatcggtatcggcgtccttggcatcgccgggatgggaatattgttgctatggcttgcagttaccctgtctgatccagcatcaccgggtgccaaagaaaccgaagtctttgataggtggaaagtgctctttgatgactatattccaccagtcagggtattggttgctgcgattatcgttgcattaattttcgtctttatcgctgccacagtggaacgaaccgtaaccaaccgctaccgaagctccgtagacggcgaaagagtgccattagcgccgaagattgtgatggcagaaacccgaggggtatttcatggaccgattaccattaacgtgctcgtgccagcacacaatgaggcggaaagaattactggaacaattcaggcattgaaatcacaacatgagcctccagaacgcatcgttgtagttgccgataattgcactgatgaaactacggaattagcccgtgctgagggagtggaggtcttggaaacagtcaataataagtttaagaaggccggaggactcaatcaggctttgagccggatgcttcccacattgggggagaatgacattgtgatgatcgttgacgctgatacagcacttgatcaaggtttcctcaaggaagcacggcgccgctttgagtctgatcgcgctctaatggccgtgggcggattgttctacggtgagtcaggctccggatggcttggccaatatcagcgcaacgaatacacccgttatagccgtgacatctatcgacgccgcggacgtgtgtttgttttgactggaacagcgtcggcttttcggccacgcggcctgcggacagtagcggaatcacgcgggacattgatccccggacgtaaagccgatgtttatgacaccgcgggcgttgaccgaagataatgagttgaccctggctttga

SEQ ID NO: 422 - protein, 309 aa, Corynebacterium glutamicum
MKKKSFPIARVIGIGVLGIAGMGILLLWLAVTLSDPASPGAKETEVFDRWKVLFDDYIPPVRVLVAAIIVALIFVFIAATVERTVTNRYRSSVDGERVPLAPKIVMAETRGVFHGPITINVLVPAHNEAERITGTIQALKSQHEPPERIVVVADNCTDETTELARAEGVEVLETVNNKFKKAGGLNQALSRMLPTLGENDIVMIVDADTALDQGFLKEARRRFESDRALMAVGGLFYGESGSGWLGQYQRNEYTRYSRDIYRRRGRVFVLTGTASAFRPRGLRTVAESRGTLIPGRKADVYDTAGVDRR

SEQ ID NO: 423 - DNA, 882 bp, Corynebacterium glutamicum
  CDS (101)..(859): RXA00042
gtggtctttgactcaaacggccagttacaacaggtccatttagaccatcaagtaatttaaatacgagcaaaactttcctgataataaaaggagtccgaccatggacatcatcatctgcaaagacgagcaagaagtcggcaaagcagcggcagccctgatcgcacccttcgcaactaagggcggaaccttggggcttgcaactggatcgtcacctttgagcacctaccaagagctcattcgcatgtatgaagctggggaagtgtcattcaagaactgcaaggcattcttgttggatgaatacgtgggattaacgcgcgacgatgaaaacagctacttcaaaaccattcgtaaagagttcactgaccacatcgacatcgttgatgaagaggtctacagcccagatggtgcaaaccctgatccatacgaagcagctgcagagtatgaggcaaagatcgctgcagaatccgttgatgttcaaatccttggcatcggcggaaacggccacatcgctttcaatgagccatcatcttctctgtcaggactgacaaaggtccaggcgctgcaccctaaaactgtggaggacaacgctcgattcttcaacaccatcgaagaggtcccaacccacgccctcacccagggtttgggcactttgtcccgcgcgcaaaacatcgtgttggtggcaactggtgaaggaaaagccgacgccatccgcggaactgtggaaggcccactgaccgccatgtgcccaggttccatcctgcagatgcacaacaatgccaccatcatcgttgatgaagcagcagcatccaagctggaaaacgctgatcactaccgtctcatggagcaattaaagctgcgctagaaacaaaaaggaaagtagtg

SEQ ID NO: 424 - protein, 253 aa, Corynebacterium glutamicum
MDIIICKDEQEVGKAAAALIAPFATKGGTLGLATGSSPLSTYQELIRMYEAGEVSFKNCKAFLLDEYVGLTRDDENSYFKTIRKEFTDHIDIVDEEVYSPDGANPDPYEAAAEYEAKIAAESVDVQILGIGGNGHIAFNEPSSSLSGLTKVQALHPKTVEDNARFFNTIEEVPTHALTQGLGTLSRAQNIVLVATGEGKADAIRGTVEGPLTAMCPGSILQMHNNATIIVDEAAASKLENADHYRLMEQLKLR

SEQ ID NO: 425 - DNA, 1998 bp, Corynebacterium glutamicum
  CDS (101)..(1975): RXA01482
ttgcgtgctgcaacttaattatggtcctcccagctcagtgtgctgtgtggattgtttattctcgtccattaagtgatcgagaaaaagttgttgtaaagtcatgcgcatgtgtggaattgttggatatattggccaagcgggcgactcccgtgattactttgctctagatgtagttgttgaaggactacgtcgcctggaataccgcggatatgactccgcaggtattgctattcacgccaatggtgagattagctaccgaaagaaggccggaaaggttgctgcactagatgcagaaatcgctaaagcacctcttccagattctattttgggaattggacacacccgttgggcaactcatggtggcccaaccgatgtcaacgctcacccccacgttgtttccaatggcaagcttgccgtagtacacaacggcatcatcgaaaactttgcggaactgcgctctgagctttccgctaagggctacaactttgtatccgataccgataccgaagttgctgcttctttgcttgctgaaatttacaatactcaggcaaacggtgacctcacccttgctatgcagctgaccggtcagcgccttgagggtgctttcaccctgctagctattcatgctgatcacgatgaccgcatcgttgcagctcgtcgtaactctcctttggttatcggcgtcggcgagggcgagaacttcctcggatctgacgtttctggctttattgattacacccgcaaggctgtagagctggctaatgaccaggttgttaccatcaccgctgatgattacgccatcaccaactttgatggatcagaagcagttggcaagcctttcgacgtggagtgggacgctgcagctgctgaaaagggtggcttcggttccttcatggagaaggaaatccacgatcagccagcagctgttcgcgataccctgatgggccgtcttgatgaagatggcaagctcgttcttgatgagctgcgcatcgatgaagctattctgcgtagtgtcgacaagatcgtcattgttgcttgtggtactgcagcttatgcaggccaggttgctcgttacgccattgagcactggtgccgcatcccaaccgaggtggagctggctcacgagttccgttaccgcgacccaatcctcaacgagaagacccttgttgtggcattgtcccagtccggcgagaccatggataccctcatggctgttcgccacgcacgtgagcagggtgccaaggttgttgctatttgtaacactgttggatccactcttccacgtgaagcagatgcgtccctgtacacctacgctggccctgagatcgctgtggcgtccaccaaggcgttcttggctcagatcactgcttcttacttgcttggcctgtacttggctcagctgcgcggcaacaagttcgctgatgaggtttcttccattctggacagcctgcgtgagatgcctgagaagattcagcaggtcatcgatgcagaagagcagatcaagaagcttggccaagatatggcagatgctaagtctgtgctgttcctgggccgccacgttggtttcccagttgcgcttgagggtgcgttgaagctcaaggagatcgcatacctgcacgctgaaggtttcgctgcaggcgagctcaagcacggcccaattgctttggttgaggaaggccagccgatcttcgttatcgtgccttcacctcgtggtcgcgattccctgcactccaaggttgtctccaacattcaggagatccgtgcacgtggcgctgtcaccatcgtgattgcagaggaaggcgatgaggctgtcaacgattacgccaacttcatcatccgcattcctcaggccccaaccctgatgcagcctctgctgtccaccgtgcctctgcagatctttgcgtgcgctgtggcaaccgcaaagggctacaacgtggatcagcctcgtaacctggcaaagtctgtcaccgtcgaataaaaagatttcgcttctcgacg

SEQ ID NO: 426 - protein, 625 aa, Corynebacterium glutamicum
MRMCGIVGYIGQAGDSRDYFALDVVVEGLRRLEYRGYDSAGIAIHANGEISYRKKAGKVAALDAEIAKAPLPDSILGIGHTRWATHGGPTDVNAHPHVVSNGKLAVVHNGIIENFAELRSELSAKGYNFVSDTDTEVAASLLAEIYNTQANGDLTLAMQLTGQRLEGAFTLLAIHADHDDRIVAARRNSPLVIGVGEGENFLGSDVSGFIDYTRKAVELANDQVVTITADDYAITNFDGSEAVGKPFDVEWDAAAAEKGGFGSFMEKEIHDQPAAVRDTLMGRLDEDGKLVLDELRIDEAILRSVDKIVIVACGTAAYAGQVARYAIEHWCRIPTEVELAHEFRYRDPILNEKTLVVALSQSGETMDTLMAVRHAREQGAKVVAICNTVGSTLPREADASLYTYAGPEIAVASTKAFLAQITASYLLGLYLAQLRGNKFADEVSSILDSLREMPEKIQQVIDAEEQIKKLGQDMADAKSVLFLGRHVGFPVALEGALKLKEIAYLHAEGFAAGELKHGPIALVEEGQPIFVIVPSPRGRDSLHSKVVSNIQEIRARGAVTIVIAEEGDEAVNDYANFIIRIPQAPTLMQPLLSTVPLQIFACAVATAKGYNVDQPRNLAKSVTVE

SEQ ID NO: 427 - DNA, 666 bp, Corynebacterium glutamicum
  CDS (1)..(666): RXN03179
gctcgtgaggcatggcgcattttcatgtcccactgggatctctacgcaggaaccgcaactggctactgggtggagcaggaatttgagcacgttttcggcatcaacgcggagcgcctgaatgttggcaccccagaacatgctgacgccatctttgatgagctgaccgatattcttgccaagccagatttccgaccacgcgcactggctgagcagttcaacttggaagttctagccaccaccgacgatccgctcgatgacctggcagatcacaaggcactggcagatgatccaaccttctcccctcgtgtgctccctaccttccgcccagacgcatacaccaagatgtacaacgctggttgggcagaaaaaaccaccaagcttatcgataccgcaggtgacggcaaggcaggctgggagggttaccttcaggcaatgcgcaaccgccgccagtacttcatcaatcacggtgcaacctccgcggaccacggtctccacgacaccgacaccaccccactgagccacaaagatgcccagaagatcttggacaagggtctcgctggcacagcaaccttggctgaaatgcatgccttcgaagccaacaccacctaccgttcgcggaaatgtccaagaagacggctggtcatgaccatccaccaggtgtgtacc

SEQ ID NO: 428 - protein, 222 aa, Corynebacterium glutamicum
AREAWRIFMSHWDLYAGTATGYWVEQEFEHVFGINAERLNVGTPEHADAIFDELTDILAKPDFRPRALAEQFNLEVLATTDDPLDDLADHKALADDPTFSPRVLPTFRPDAYTKMYNAGWAEKTTKLIDTAGDGKAGWEGYLQAMRNRRQYFINHGATSADHGLHDTDTTPLSHKDAQKILDKGLAGTATLAEMHAFEANTTYRSRKCPRRRLVMTIHQVCT

SEQ ID NO: 429 - DNA, 672 bp, Corynebacterium glutamicum
  CDS (1)..(672): FRXA02872
gctcgtgaggcatggcgcattttcatgtcccactgggatctctacgcaggaaccgcaactggctactgggtggagcaggaatttgagcacgttttcggcatcaacgcggagcgcctgaatgttggcaccccagaacatgctgacgccatctttgatgagctgaccgatattcttgccaagccagatttccgaccacgcgcactggctgagcagttcaacttggaagttctagccaccaccgacgatccgctcgatgacctggcagatcacaaggcactggcagatgatccaaccttctcccctcgtgtgctccctaccttccgcccagacgcatacaccaagatgtacaacgctggttgggcagaaaaaaccaccaagcttatcgataccgcaggtgacggcaaggcaggctgggagggttaccttcaggcaatgcgcaaccgccgccagtacttcatcaatcacggtgcaacctccgcggaccacggtctccacgacaccgacaccaccccactgagccacaaagatgcccagaagatcttggacaagggtctcgctggcacagcaaccttggctgaaatgcatgccttcgaagccaacaccacctaccgtttcgcggaaatgtcccaagaagacggcctggtcatgaccatccacccaggtgtgtaccgc

SEQ ID NO: 430 - protein, 224 aa, Corynebacterium glutamicum
AREAWRIFMSHWDLYAGTATGYWVEQEFEHVFGINAERLNVGTPEHADAIFDELTDILAKPDFRPRALAEQFNLEVLATTDDPLDDLADHKALADDPTFSPRVLPTFRPDAYTKMYNAGWAEKTTKLIDTAGDGKAGWEGYLQAMRNRRQYFINHGATSADHGLHDTDTTPLSHKDAQKILDKGLAGTATLAEMHAFEANTTYRFAEMSQEDGLVMTIHPGVYR

SEQ ID NO: 431 - DNA, 533 bp, Corynebacterium glutamicum
  CDS (1)..(510): RXN03180
ttcggtgagaacaaagatctcatctctgacagcagtttcaaccgctggctgcgtacggtttccctcggatcgacccaggatgccgatatggctgcagcttccaacttggcagccaattctaaaatggcccgccagaacacccgcgatatcctcgacgcagtctctgatggtggcgtcatgctcggccgaaacggtgccctagtgttgggacctgtggttggaactctccacattaaattcattgcgcctttgaacaagcgtgtggaaagagtcatgtacaaaactggactctcagaagctgctgcagctgagcaatgtgctttggaggatcgtctccgcgaagagatggcccacgctttgtatcaatggaatccgggacgcgatgaaaactatgacctcgtgatcaacaccggttcgatgacatacgaacaaatcgttgatctagttgtggaaacttacgccaggaagtatccgctccacgtgagaatcattccgaacggaaaagaccaataaacatacagtccccgtgatgt

SEQ ID NO: 432 - protein, 170 aa, Corynebacterium glutamicum
FGENKDLISDSSFNRWLRTVSLGSTQDADMAAASNLAANSKMARQNTRDILDAVSDGGVMLGRNGALVLGPVVGTLHIKFIAPLNKRVERVMYKTGLSEAAAAEQCALEDRLREEMAHALYQWNPGRDENYDLVINTGSMTYEQIVDLVVETYARKYPLHVRIIPNGKDQ

SEQ ID NO: 433 - DNA, 533 bp, Corynebacterium glutamicum; identical to SEQ ID NO: 431
  CDS (1)..(510): FRXA02873

SEQ ID NO: 434 - protein, 170 aa, Corynebacterium glutamicum; identical to SEQ ID NO: 432

SEQ ID NO: 435 - DNA, 798 bp, Corynebacterium glutamicum
  CDS (101)..(775): RXA02292
tgcaccacgccagctgcaaccctgcgcggtggtctgggaagttggtggaggggatcgtcgaaaagcgtaggcactaaagttctcctgcacaatggaggatatggacaatgactttgaatctatcgagaaaatgagcagcggcgattggtacgtggctaccggcgcggaacgtgaagaagtggcacaaaaaacagcgttacttttccacgaatacaaccaaattggacctacagaccccgcacgaactgccgaaatactaagaactgtactaaatcctgccagcggaacctgcacgatcaaagcgccagccatcattgaatacggcttcaacaccacgatcggcgagcatgtgttcatcaactttggcctcaccattttagatatcgcaccggttcgcatcggggcacgcagcatgctcgggccaaactgtcagctcttcaccgcaggtcacccggtcgatgactgggaaatgcgctccggtgggtgggaaaatggcgcacccatttccattggcgaggatacgtggctgggtggaaatgtcaccgtcgttggtggcgtgagcattggcgataggtgtgtgattggcgcggggcccgtggtgaccaaggatattccggatgattctattgctgtgggcaaccctgcgcgagtagtgcggaaacgtgatgatagccggctcgaacgttcgcagctgccagaaggtgcttccgtggatgcgttggggattcttcctacaaaatcacctaggctgtcagaaaatattgccgaaaaatattaaatacgcaggcactaagaaga

SEQ ID NO: 436 - protein, 225 aa, Corynebacterium glutamicum
MDNDFESIEKMSSGDWYVATGAEREEVAQKTALLFHEYNQIGPTDPARTAEILRTVLNPASGTCTIKAPAIIEYGFNTTIGEHVFINFGLTILDIAPVRIGARSMLGPNCQLFTAGHPVDDWEMRSGGWENGAPISIGEDTWLGGNVTVVGGVSIGDRCVIGAGPVVTKDIPDDSIAVGNPARVVRKRDDSRLERSQLPEGASVDALGILPTKSPRLSENIAEKY

SEQ ID NO: 437 - DNA, 891 bp, Corynebacterium glutamicum; identical to SEQ ID NO: 283
  CDS (101)..(868): RXA02666

SEQ ID NO: 438 - protein, 256 aa, Corynebacterium glutamicum; identical to SEQ ID NO: 284

SEQ ID NO: 439 - DNA, 1065 bp, Corynebacterium glutamicum; identical to SEQ ID NO: 325
  CDS (101)..(1042): RXA00202

SEQ ID NO: 440 - protein, 314 aa, Corynebacterium glutamicum; identical to SEQ ID NO: 326

SEQ ID NO: 441 - DNA, 963 bp, Corynebacterium glutamicum
  CDS (101)..(940): RXA02440
gctgttaatcacgggttgttcagctaccgggggagcaccacgggcaacagatggggcatcaggcggaggaaccgtcgatacgcctcggttggttgtcgcgatggtgagccacggcgcgccgggcgatactttttgggatttggtccgaaaaggtgctgaagacgccgcccaaaaagacaacgttgaactccgctattcctctaatccggaaatccctgaacaatccaacctcgtgcaaaatgccatcgattcacgcgtcgacggcatcgccatgaccatgcctaatgctcaatcactaggaccggtcgctcaaaaggccgtggatgcgggcattcctgtggttggtctcaacgctggaatgaacgaataccaagattatggaatgacaggattctttggtcaagatgaatccgtcgcaggagcatccgcaggagcgcgccttgccgaggaaaacgcacaaaaagttttgtgtgtgatccatgaacagggcaactcctcccaggaagctcgctgtggtggcgtgtctgaaggtttgggcaaacaagtagaaaccctgtatgtcaacggcatggatctcacctcagtgaactccaccctgcaggcaaaacttgctcaagaccgcagcattgattgggttgtgggactccaggctggtgtatcaatggctatttctgatgcggcagacgctgcgaactcagaagtaaagatcgccacctttgatacaaacgcacagctcatgaccgctattcgtgatggcaagatccaattcgccattgatcagcaaccatatctgcagggctacatggccgtggattcgctgtggttggcgcaccgaaacggcaccactgttggtggcggacgacccgtgtacacaggaccagccattgtggatgccaccaacgttgatgtcattgctgaagccgttggggagggtctgcgatgacaaaaatcaagagtggggag

SEQ ID NO: 442 - protein, 280 aa, Corynebacterium glutamicum
MVSHGAPGDTFWDLVRKGAEDAAQKDNVELRYSSNPEIPEQSNLVQNAIDSRVDGIAMTMPNAQSLGPVAQKAVDAGIPVVGLNAGMNEYQDYGMTGFFGQDESVAGASAGARLAEENAQKVLCVIHEQGNSSQEARCGGVSEGLGKQVETLYVNGMDLTSVNSTLQAKLAQDRSIDWVVGLQAGVSMAISDAADAANSEVKIATFDTNAQLMTAIRDGKIQFAIDQQPYLQGYMAVDSLWLAHRNGTTVGGGRPVYTGPAIVDATNVDVIAEAVGEGLR

SEQ ID NO: 443 - DNA, 1482 bp, Corynebacterium glutamicum
  CDS (101)..(1459): RXN01569
aaggcctagagcagaccatcgattggtaccgcgaaaacgaggcctggtggcgccctgccaagaacaacgtcgaagctacctacgctaagcagggacaataatggaatacggtaaacaactcacctcccacaccaccgacatcgaaggcctactggttttcgatttccccgtccacggcgacaaccgcggctggttcaaggaaaattggcagcgcaccaagatgaccaacctggggctgcccgattttggccccgtccaaaacaacatgagtttcaacgccaccgccggcacgactcgcggcatgcacgctgagccgtgggataaatttgtgtccgtcgcggtgggttccgttttcggagcttgggtggatctgcgcgcgggctcgagcacgtacggtaacgtcgtaacgcaaaaaattacccctgacgtgggagtttacgtcccgcgtggtgtggcaaacggcttccaggcgctcgaggacggcacgctgtacacctacctcgtcaacgatcattggtcccccgacgcgcattacgccaacgtcaacctcaacatgatcgactggccgctgcccatcaccgagatctccgaaaaagataaaaaacatccagcgcttatcgacgccacccccctgcccgcccgcaaggttctcgtggtcggcgccggcggacaactgggaaccgcgctacgcgcgcagttcccagacgcggaatttgtcacgcgccaagaactcgatatcacctcagatctcaccgaggctcgcgcgtggaaacaatactccaccatcataaacgccgccgcctacactgccgttgaccaggcagaacacgaccgcgcagcagcgtgggacatcaacgcagcggcagtggctaacctcgcgaccatcgcgcgcgacaacaacctcaccctcgtgcacgtgtcctcagattatgtcttcgacggtgcggccgaatcctacgatgaaaacgcaccgttttccccactcggcgtgtacggccaatccaaagcagccggcgacatcggagacaccaccgcaccgcgccactacattgtgcgcaccagctgggtgattggcgatggcaataattttgtccgcaccatgaaatccctcgacgaacgcggcatcgcaccatcagtagttgatgatcaaatcggccgcctatccttcaccgaagacatcgcagccggcatcgcgcaccttttggaagtgggtgcagcatatggcacctacaacctcaccaacaccggcgaacccgcaagctgggccgatgttgcccgcgcagtattttccgaccccaccaaagttaccggcgtgagcaccgccgagtacttcgccaacaaagacgcagcgccccgcccactgaactccgttttggatctcggcaaaatcgaagccaccggatttagcgcaccgacctggcagacccgcctcaacgactacctcaaggaactctcaaagtgaaaggcatcatcctcgcaggt

SEQ ID NO: 444 - protein, 453 aa, Corynebacterium glutamicum
MEYGKQLTSHTTDIEGLLVFDFPVHGDNRGWFKENWQRTKMTNLGLPDFGPVQNNMSFNATAGTTRGMHAEPWDKFVSVAVGSVFGAWVDLRAGSSTYGNVVTQKITPDVGVYVPRGVANGFQALEDGTLYTYLVNDHWSPDAHYANVNLNMIDWPLPITEISEKDKKHPALIDATPLPARKVLVVGAGGQLGTALRAQFPDAEFVTRQELDITSDLTEARAWKQYSTIINAAAYTAVDQAEHDRAAAWDINAAAVANLATIARDNNLTLVHVSSDYVFDGAAESYDENAPFSPLGVYGQSKAAGDIGDTTAPRHYIVRTSWVIGDGNNFVRTMKSLDERGIAPSVVDDQIGRLSFTEDIAAGIAHLLEVGAAYGTYNLTNTGEPASWADVARAVFSDPTKVTGVSTAEYFANKDAAPRPLNSVLDLGKIEATGFSAPTWQTRLNDYLKELSK

SEQ ID NO: 445 - DNA, 449 bp, Corynebacterium glutamicum
  CDS (1)..(426): FRXA01569
gcaccgcgccactacattgtgcgcaccagctgggtgattggcgatggcaataattttgtccgcaccatgaaatccctcgacgaacgcggcatcgcaccatcagtagttgatgatcaaatcggccgcctatccttcaccgaagacatcgcagccggcatcgcgcaccttttggaagtgggtgcagcatatggcacctacaacctcaccaacaccggcgaacccgcaagctgggccgatgttgcccgcgcagtattttccgaccccaccaaagttaccggcgtgagcaccgccgagtacttcgccaacaaagacgcagcgccccgcccactgaactccgttttggatctcggcaaaatcgaagccaccggatttagcgcaccgacctggcagacccgcctcaacgactacctcaaggaactctcaaagtgaaaggcatcatcctcgcaggt

SEQ ID NO: 446 - protein, 142 aa, Corynebacterium glutamicum
APRHYIVRTSWVIGDGNNFVRTMKSLDERGIAPSVVDDQIGRLSFTEDIAAGIAHLLEVGAAYGTYNLTNTGEPASWADVARAVFSDPTKVTGVSTAEYFANKDAAPRPLNSVLDLGKIEATGFSAPTWQTRLNDYLKELSK

SEQ ID NO: 447 - DNA, 1028 bp, Corynebacterium glutamicum
  CDS (101)..(1021): FRXA02055
aaggcctagagcagaccatcgattggtaccgcgaaaacgaggcctggtggcgccctgccaagaacaacgtcgaagctacctacgctaagcagggacaataatggaatacggtaaacaactcacctcccacaccaccgacatcgaaggcctactggttttcgatttccccgtccacggcgacaaccgcggctggttcaaggaaaattggcagcgcaccaagatgaccaacctggggctgcccgattttggccccgtccaaaacaacatgagtttcaacgccaccgccggcacgactcgcggcatgcacgctgagccgtgggataaatttgtgtccgtcgcggtgggttccgttttcggagcttgggtggatctgcgcgcgggctcgagcacgtacggtaacgtcgtaacgcaaaaaattacccctgacgtgggagtttacgtcccgcgtggtgtggcaaacggcttccaggcgctcgaggacggcacgctgtacacctacctcgtcaacgatcattggtcccccgacgcgcattacgccaacgtcaacctcaacatgatcgactggccgctgcccatcaccgagatctccgaaaaagataaaaaacatccagcgcttatcgacgccacccccctgcccgcccgcaaggttctcgtggtcggcgccggcggacaactgggaaccgcgctacgcgcgcagttcccagacgcggaatttgtcacgcgccaagaactcgatatcacctcagatctcaccgaggctcgcgcgtggaaacaatactccaccatcataaacgccgccgcctacactgccgttgaccaggcagaacacgaccgcgcagcagcgtgggacattaacgcagcggcagtggctacctcgcgaccatcgcgcgcgacaacaacctcaccctcgtgcacgtgtcctcagattatgtcttcgacggtgcgggcgaatcctacgatgaaaacgcaccgttttccccactcggcgtgtacggccaatccaaagcagccggcgacatcgtaagcac

SEQ ID NO: 448 - protein, 307 aa, Corynebacterium glutamicum
MEYGKQLTSHTTDIEGLLVFDFPVHGDNRGWFKENWQRTKMTNLGLPDFGPVQNNMSFNATAGTTRGMHAEPWDKFVSVAVGSVFGAWVDLRAGSSTYGNVVTQKITPDVGVYVPRGVANGFQALEDGTLYTYLVNDHWSPDAHYANVNLNMIDWPLPITEISEKDKKHPALIDATPLPARKVLVVGAGGQLGTALRAQFPDAEFVTRQELDITSDLTEARAWKQYSTIINAAAYTAVDQAEHDRAAAWDINAAAVATSRPSRATTTSPSCTCPQIMSSTVRANPTMKTHRFPHSACTANPKQPATS

SEQ ID NO: 449 - DNA, 1056 bp, Corynebacterium glutamicum; identical to SEQ ID NO: 285
  CDS (101)..(1033): RXA00825

SEQ ID NO: 450 - protein, 311 aa, Corynebacterium glutamicum; identical to SEQ ID NO: 286

SEQ ID NO: 451 - DNA, 1140 bp, Corynebacterium glutamicum
  CDS (101)..(1117): RXA02054
cctaatgaacagccggagcaccctggtcgtttgcagaataggcgcatcgacaacagctactaactctgccagctcgcccggacgaactaaggtagacggcatgacttctttgcttgtgaccggaggtgccggatttatcggcgccaacttcgtccgccaaaccgtagagcagcaccctgaatacacccacatcacggtgctggataaactcacctacgcaggaaacgccgacaatctcaaaggcctccccgacagcaaagtaaccctcatcgaaggcgatatctgcgatgctgaattagtcgactccctggtcaaagaccacgacatcacagtccacttcgcagcagaatcccacaacgacaactccctcaacgacccctccccgtttgttcacactaacctcatcggcacctttgtcctgctagaagcagtccgcaagcacaacaaacgcttccaccacatctccaccgatgaagtcttcggcgatctagagctggatgatccaaaccgcttcactgaaaccaccgcctacaagccatcgtctccatattctgcaaccaaggcagggtctgatcacttggtacacgcatggatccgctccttcggaatccaggcaaccatgtctaactgctccaacaattacggtccctaccagcacattgaaaagttcatcccccgccagatcaccaatattctggccggcctgacaccaaaactttatggaaccggcgagcaggtccgcgactggatccacgtcgatgatcacaatgacgccgtccacctgatcctgagtaagggcaagatcggcgaaacctacatcatcggcgccgacaacgatcatgtgaataacaagcaggtcatcgagcttatttgtgaactcatgggcctcgacaaaaacgcatacgagcacgtcgcagaccgccccggccacgatatgcgttacgccatggattccaccaagctgcgcaccgagctcggctgggcacctaaatacaccgacgttgattccggcatgcgcaaaggcctagagcagaccatcgattggtaccgcgaaaacgaggcctggtggcgccctgccaagaacaacgtcgaagctacctacgctaagcagggacaataatggaatacggtaaacaactc

SEQ ID NO: 452 - protein, 339 aa, Corynebacterium glutamicum
MTSLLVTGGAGFIGANFVRQTVEQHPEYTHITVLDKLTYAGNADNLKGLPDSKVTLIEGDICDAELVDSLVKDHDITVHFAAESHNDNSLNDPSPFVHTNLIGTFVLLEAVRKHNKRFHHISTDEVFGDLELDDPNRFTETTAYKPSSPYSATKAGSDHLVHAWIRSFGIQATMSNCSNNYGPYQHIEKFIPRQITNILAGLTPKLYGTGEQVRDWIHVDDHNDAVHLILSKGKIGETYIIGADNDHVNNKQVIELICELMGLDKNAYEHVADRPGHDMRYAMDSTKLRTELGWAPKYTDVDSGMRKGLEQTIDWYRENEAWWRPAKNNVEATYAKQGQ

SEQ ID NO: 453 - DNA, 909 bp, Corynebacterium glutamicum
  CDS (101)..(886): RXN00427
gcggtcattgtgacccacaatcgtgtggaattgctgcggcattccctcgaggttgttgccaatcaaacctatccggtgaaacacattgtggtggtggataatggggcggatcctagtattctatagtgtcactttagaggtggcgggagaccgtcccgtttacacgccttcgcgcaccaatttgggcgacggtggcggttttgcttttggttttttgacggcgttggcgctgggggcgaacgcggtgtggtgcacagacgatgacggccggccggaggggccaggggtgttgaagacgcttatcgacgccgcttctcggcataatctggaggaggtttctccggtggtatgcaatgctgatgatccggagcggttggcatttccgctgcgtcggggcttggagtggcgtcggatgcgcagtgagttgattgatccagccaacccggaggatgatttgctgccgggcatcgcctccttgttcaatggtgccctgatcagcgcttatgcaatggagcgcattggcgtgccggactatcgactgtttattcgcggcgatgaggtggagtatcaccgccgtttggtgcgttccggtttgccgtttggtacgtgtttgaccacggcgtatttgcacccggatggttctgatgagttcaagccgattctgggtgggcggatgcatacgcagtatccggataatgatttcaagaggtttttcacctaccgcaaccgtggctacctgatgagccagccgggaatgcgcaagcttctccctcaggaatatgcgcgctttgcgtggttcttcctggttcagaaacgggatgtgaagggattccgggagtggctgcgcctgcacaaactgggccgcgacgagaaattcaataggccctagatcagttttagtagttcctc

SEQ ID NO: 454 - protein, 262 aa, Corynebacterium glutamicum
MGRILVFYSVTLEVAGDRPVYTPSRTNLGDGGGFAFGFLTALALGANAVWCTDDDGRPEGPGVLKTLIDAASRHNLEEVSPVVCNADDPERLAFPLRRGLEWRRMRSELIDPANPEDDLLPGIASLFNGALISAYAMERIGVPDYRLFIRGDEVEYHRRLVRSGLPFGTCLTTAYLHPDGSDEFKPILGGRMHTQYPDNDFKRFFTYRNRGYLMSQPGMRKLLPQEYARFAWFFLVQKRDVKGFREWLRLHKLGRDEKFNRP

SEQ ID NO: 455 - DNA, 555 bp, Corynebacterium glutamicum
  CDS (101)..(532): FRXA00427
tgctgatgatccggagcggttggcatttccgctgcgtcggggcttggagtggcgtcggatgcgcagtgagttgattgatccagccaacccggaggatgatttgctgccgggcatcgcctccttgttcaatggtgccctgatcagcgcttatgcaatggagcgcattggcgtgccggactatcgactgtttattcgcggcgatgaggtggagtatcaccgccgtttggtgcgttccggtttgccgtttggtacgtgtttgaccacggcgtatttgcacccggatggttctgatgagttcaagccgattctgggtgggcggatgcatacgcagtatccggataatgatttcaagaggtttttcacctaccgcaaccgtggctacctgatgagccagccgggaatgcgcaagcttctccctcaggaatatgcgcgctttgcgtggttcttcctggttcagaaacgggatgtgaagggattccgggagtggctgcgcctgcacaaactgggccgcgacgagaaattcaataggccctagatcagttttagtagttcctc

SEQ ID NO: 456 - protein, 144 aa, Corynebacterium glutamicum
LLPGIASLFNGALISAYAMERIGVPDYRLFIRGDEVEYHRRLVRSGLPFGTCLTTAYLHPDGSDEFKPILGGRMHTQYPDNDFKRFFTYRNRGYLMSQPGMRKLLPQEYARFAWFFLVQKRDVKGFREWLRLHKLGRDEKFNRP

SEQ ID NO: 457 - DNA, 507 bp, Corynebacterium glutamicum
  CDS (101)..(484): RXA00327
aacgattttcgccgtcgcaaccgtgatcaccggtcgctttccggcatcgtgtcgtcgcggctagggggccaggcgcgggatgattgggtttgtcacgccgatgattcaggcggcgttgtggatcgtgctctttttattcgctgatcgcctgtccaatccgctggtttttgtcagcgccatcatgttcgcgatttcctttagctcccccgtggcgaacttcggtttcgatacgatctgcgaaaaactcgaccgccgcgtcatggtcgccggcaccggcatggccaacatgagcgcctacatttgcgcgatgctggccacacaaatcatcggatttttactcgactggaacgccgacggccacgcctacacctggtcgaatttccaggtggcgtggcttggtctgggcgcggtgtggctggcaggcatgatcgggcttgcagtctgcctcctgctgcagcgtcgaaaaaatattgcttttcgacgctaaaacccgaccgtaaccgctag

SEQ ID NO: 458 - protein, 128 aa, Corynebacterium glutamicum
MIQAALWIVLFLFADRLSNPLVFVSAIMFAISFSSPVANFGFDTICEKLDRRVMVAGTGMANMSAYICAMLATQIIGFLLDWNADGHAYTWSNFQVAWLGLGAVWLAGMIGLAVCLLLQRRKNIAFRR

SEQ ID NO: 459 - DNA, 615 bp, Corynebacterium glutamicum
  CDS (101)..(592): RXA00328
gtcacgggatttgttgtagcccgactcaagggtggaccgggccgcagattactcgcccagattaggtctaccaaggacttttaaagatcgggtaaaacctgtgggcgttgaaaggggcaaggtctctgccaaggcactagttgtctggttgacggcaatgtgcgtgtacatcgtggccattgctggtcgaacatcatttggtgtcgccggagtgcatgcgatcgatcgctttgatatcgacgcctcccggttggccgtgttcacttctgttcaggttggagtctatgttctcgcgcagattcccatgggcatgctggtggacaggttcgacgcccggaaactcttgctggctggcgctttaattttggcagctggccagctcattttgggtttcactgattcttatatgatcgccatttttgcccgagtgctcatcagtgttggcgattcttctgcatttttgtccgtgatgcgactgttgcccaactggttcccgatgtcttggacacctgtgttgcagcagctcacgggcgcttttggctttgtggggcagttttctccgcggtgccgtttttgcacatactcaacaccttagggtggacaattcctttcgca

SEQ ID NO: 460 - protein, 164 aa, Corynebacterium glutamicum
VGVERGKVSAKALVVWLTAMCVYIVAIAGRTSFGVAGVHAIDRFDIDASRLAVFTSVQVGVYVLAQIPMGMLVDRFDARKLLLAGALILAAGQLILGFTDSYMIAIFARVLISVGDSSAFLSVMRLLPNWFPMSWTPVLQQLTGAFGFVGQFSPRCRFCTYSTP

SEQ ID NO: 461 - DNA, 1347 bp, Corynebacterium glutamicum
  CDS (101)..(1324): RXA00329
tgtgaagaacaatgatcaacggccttcgccaagaccgcatcccagagagaaagtaactacccgcgccctcatagtttgggcagcagcctgtcttgtgtatatggcagccattaccagccgcaccagctttggtgtggctggagtggaggccattgatcgttttcaggtagacgccacacgcattgcagtattcacttctgttcaggttggtgtgtacgcgtttgctcagattccgatgggcattttgatcgataagtttggtcctcggaagctccttgccattggtgctttggtgatgggtatcggccagctcattttgggctttacggatagctattccatcgcgattattgcccgcgtgtttatcggcgccggcgatgcatcgatcttcctttcggttatgcgcatcctgccgttttggttcccactgaagcacacccctattttcacgcagttaactacctgccttggccagttgggccagttcttttctgcggtgcctttcatggcgttgttgggtgcgcagggttggcctgtggcgtttgtcagccttggttccgtggtggcactcattgcgatcgcagcgctggtggccgttcgggatactccagatcctcagccaaaacctgtcgaatcagctcaggaagcagataaaccaagcctgcgcgcgagtttgaagttgattgtccgcaatccgattacgtggcagggtttcttcattcactacgtattgatggtgtggcagaccgtgttctccatgatgtggggcgtcccgctgatgactttgggcatgggactgtctgcaacgacggctggtttggtgttgagcatcaacacgctgtgcatggtggtatcggcgccaatcatcggaataatttccgcacgccttgggtatcgccgtgacgtggtcgccattgcgctgtcgtttgttcaatccgcagtatggctggtgttcttggcctccgatgcacctcgtggtttgatggctatcatcttggtcaacatcgtcatgggtctgactactgcggcttctggttatggctttgacaccattcgtgagcgcctagatcgcaagattttggctgcgggcacgggactggcaaacatgggtggattcttgtcatcgatggttgcagcgcaggttatggggttccttcttgatcacagcgcgcatggtagcacctatacttgggtggacttccgttttggtttccttgcgattcttgtcacatgggccgtcggagtcacgggatttgttgtagcccgactcaagggtggaccgggccgcagattactcgcccagattaggtctaccaaggacttttaaagatcgggtaaaacctgtgg

SEQ ID NO: 462 - protein, 408 aa, Corynebacterium glutamicum
MAAITSRTSFGVAGVEAIDRFQVDATRIAVFTSVQVGVYAFAQIPMGILIDKFGPRKLLAIGALVMGIGQLILGFTDSYSIAIIARVFIGAGDASIFLSVMRILPFWFPLKHTPIFTQLTTCLGQLGQFFSAVPFMALLGAQGWPVAFVSLGSVVALIAIAALVAVRDTPDPQPKPVESAQEADKPSLRASLKLIVRNPITWQGFFIHYVLMVWQTVFSMMWGVPLMTLGMGLSATTAGLVLSINTLCMVVSAPIIGIISARLGYRRDVVAIALSFVQSAVWLVFLASDAPRGLMAIILVNIVMGLTTAASGYGFDTIRERLDRKILAAGTGLANMGGFLSSMVAAQVMGFLLDHSAHGSTYTWVDFRFGFLAILVTWAVGVTGFVVARLKGGPGRRLLAQIRSTKDF

SEQ ID NO: 463 - DNA, 2265 bp, Corynebacterium glutamicum
  CDS (101)..(2242): RXN01554
tggcttaaaccttatttgtagttgtcaataaatatgaaattccttagcaacttgtttaaatagacgtataaacaagtttgaaaaaggaaggttatccatcttgaaaaagcatgtgacctcagccgttaccgccgtggtgacggctttttcaacggctgcgcttggtttaagtattgccgtttctcctgctgttgcccaagtggctaatccagctccagatctttctgcgccgtatacatgggtggaagagtttgattccgaggatgctctcaaagggtggaacattttccgccagccagattatggcagcgacaaagttctctataccgaagatgctttaagtatcgaagatggcaagctcaccatcaccactcagcgccactgcgttgacgaagacttcgcgatcagtgatcctgtcaaccgcggaaagctcaatgacagcaccgcgcaagttgaaccttgtgctccaggtcagtttgaaaagttcaccagtgcgcgcatcgtcactccgaaaattgctcgtggagagttcgacctttctgtcactgcaactcttaacaccggtggcgtcgaaggtgtccgaagtgccatttggatgcaaaacggtgaacaggcgtgttcctcagcaaccaacaatggcctctacggagaactagacctggtagagcacttttcttacgatcttcgctcgccatggtctccatcaaacacccacttgggttgtgatcctgaaagtgtcaacggcaccaaccgtgcacctcgtgaacttaaactagatgagtcactcgatggcgtggagcacacctggactgtgagcaccacccgcgacggcgttgagtacttcattgatgatgaggcgattaaccgccagtcatggcgcaacgatgtcactttggggcatgccgaaattgatgatttcgggatctccgcgcagacgtttgatgagatcgtcgaccgcgaatggactctcactcttaatcaaaaggtagaaagcgccgactgggcaaaaccacgttcctctgaggaagatttcccagtccggtccatggtgattgaccgcatcgaggtcaccggatctcccgcagtatctgaagacacccccatgccagataccacccagcttttgacccaagacactctggaatacctcggtcgcatgccagtgctggaacgctacgagccagcaagtgctgattttgccgatggccgcaggccttcctggaactacttcaatttgaaggaatcgtggcagaatccagaactcgagcaacgcccagaagctgtcgaattcgttgatggacgcatggatatcgtgacccgtcgccactgtctggccaccactgatgacatcgccactccggaaaacgcacaggaggaaccgtgcgcgccgggtgaggtgacacgctacagctcagcgcgtgtccaccttccagagatccccgccggcaacttccggctcaccgtgcgcgcacgggcgcagtccgaagagcttgtcgacggcgtccgccccgctatctggatgcagaacaataccaacttctgtgctgacaacgatggacgcccttatggtgaactggatattactgagttctacagctctcgtgtgaacacccagtactcggcagtacaccttggatgtgctggcaaccgcccagagatgaagcttcgccaaatggaaatggaagagtccatgtttggggattggcatgactggggcgtcgaagtcttcgacggccagatcgtattcaccattgacggcaaggcagtaacttcctctggcaaagatgtctttggcaactctgttaccccagccgctgcacctcttcgccccgcgcacttcaagttgtcggaagaggaataccgtgaagtcatcgggcagccttggcaccttattttgaacaccatggtggagcagtctggcaaagacagctggattacagcggtcgacaataacgaggcgttcccagaacaccgcttccaaattgaccatgtggcagtagatatcgagtctgactctgtggacaatgtatggcctgacgctgcgaatgaaatcccagacaatgttggtattgaagactctgatgatggcagcgacctggaggttggttcgaccggaagctctacagctgagaccgtgagctggatctcgttgttcaccgcgttgagctcgctggtcttcacactggctctcaatcaagaagcattgcagaatttgattaatcagttcatgagacagttcaagtaatccttgtgggcgctttgtct

SEQ ID NO: 464 - protein, 714 aa, Corynebacterium glutamicum
LKKHVTSAVTAVVTAFSTAALGLSIAVSPAVAQVANPAPDLSAPYTWVEEFDSEDALKGWNIFRQPDYGSDKVLYTEDALSIEDGKLTITTQRHCVDEDFAISDPVNRGKLNDSTAQVEPCAPGQFEKFTSARIVTPKIARGEFDLSVTATLNTGGVEGVRSAIWMQNGEQACSSATNNGLYGELDLVEHFSYDLRSPWSPSNTHLGCDPESVNGTNRAPRELKLDESLDGVEHTWTVSTTRDGVEYFIDDEAINRQSWRNDVTLGHAEIDDFGISAQTFDEIVDREWTLTLNQKVESADWAKPRSSEEDFPVRSMVIDRIEVTGSPAVSEDTPMPDTTQLLTQDTLEYLGRMPVLERYEPASADFADGRRPSWNYFNLKESWQNPELEQRPEAVEFVDGRMDIVTRRHCLATTDDIATPENAQEEPCAPGEVTRYSSARVHLPEIPAGNFRLTVRARAQSEELVDGVRPAIWMQNNTNFCADNDGRPYGELDITEFYSSRVNTQYSAVHLGCAGNRPEMKLRQMEMEESMFGDWHDWGVEVFDGQIVFTIDGKAVTSSGKDVFGNSVTPAAAPLRPAHFKLSEEEYREVIGQPWHLILNTMVEQSGKDSWITAVDNNEAFPEHRFQIDHVAVDIESDSVDNVWPDAANEIPDNVGIEDSDDGSDLEVGSTGSSTAETVSWISLFTALSSLVFTLALNQEALQNLINQFMRQFK

SEQ ID NO: 465 - DNA, 389 bp, Corynebacterium glutamicum
  CDS (101)..(382): RXN03015
ccgggtttgcctgaggttttggagcgcaatctggaaaatggtcgcctgaacttcactactgattatgcggaggctgcggctttcgcgcaggtgcatttctttgggcgtgggtactcctcagcagaagggtacttatgcggcggatctgacgtatgttcgtcaggttgttgaggatttggtgccgctgcttgagggcgagcacattattttcggcaagtctacggttccggttggtactgctgagcagttgcaggagcttgctgattctctggtcaagcctggttcgcacgtggagatcgcgtggaatccggagttcttgcgtgagggctacgcggtcaaagacaccatcactccggaccgcatcgtggtgggtgtgcgtgaataagaca

SEQ ID NO: 466 - protein, 94 aa, Corynebacterium glutamicum
LGVGTPQQKGTYAADLTYVRQVVEDLVPLLEGEHIIFGKSTVPVGTAEQLQELADSLVKPGSHVEIAWNPEFLREGYAVKDTITPDRIVVGVRE

SEQ ID NO: 467 - DNA, 801 bp, Corynebacterium glutamicum
  CDS (101)..(778): RXN03056
ttactatcactggttttgcagatgagatcgcacatgatctcgacgaacagatttccttacttaataaactgaagaacagctcgcggaagctaaagccaaattggatgccgcaggaatttcactttcagccgttggatccgacttcggcaagatcaacatcaccgatccttttgaagatcacttggagcgcgcacgccacggtgttgaggtcgctaagctcttcggcgcgaaatacatccgcatgttctccttctttattgcagaaggcgacaaccctgaaagcttccgcaaagaagtactctcccgcacccacgcaatggtcgaactcgcagaagccggcggcatcaccctcctccacgaaaatgaaaagggaatctatggcgactccccgcagcgcgtgaaggatttaatcaccagcatcgactcccctaactaccgcgcaatctacgacgcagctaactacgtgcaaaccggattcaagccttttgatgaggcatggccgatcgttaaggactacgtcgactacgtccacatcaaggacgcgaccattccagatgcagagcaccccatcggaatcatcaagccagcaggacaaggcgacggccaatacccagagctccttgccgcgctaaacgccgacggttacaacggattcgtctccatcgagcctcacctgggtgacttcgatgaattcggcggactctgcggacctgacctgtggaccagcgcatgcgacgctctcgcaggaatcctgaacaacatcaacgccgagtacaactaaggacaactgataatgacaaa

SEQ ID NO: 468 - protein, 226 aa, Corynebacterium glutamicum
LDAAGISLSAVGSDFGKINITDPFEDHLERARHGVEVAKLFGAKYIRMFSFFIAEGDNPESFRKEVLSRTHAMVELAEAGGITLLHENEKGIYGDSPQRVKDLITSIDSPNYRAIYDAANYVQTGFKPFDEAWPIVKDYVDYVHIKDATIPDAEHPIGIIKPAGQGDGQYPELLAALNADGYNGFVSIEPHLGDFDEFGGLCGPDLWTSACDALAGILNNINAEYN

SEQ ID NO: 469 - DNA, 687 bp, Corynebacterium glutamicum
  CDS (101)..(664): RXN03030
gaagatgaagcagaaaagatcattggtgcgccagaggtttctgcattgggcaacaaagcacagcttgattccgtcaccttgctgcgtaacaaccccatccgtgctgccactggatcctgcagcaagcctgaagatctacccattggttactggccgtaccaagatcgacgaggttcaactacagctggaagcagccattcgcgcagaactcccaggggtaaccttggtgtcttccgagtcagaagcagatcttgcaatcgtgtgggctcgccctgaaattgcactgtttgaagatgacctcgaaggtgtttccctctctgttgaccctcgtgccaatggtgtcgatgtggaacgcgttcaggctgtggaagctgcagtcccaaccatcttggctgtgaacttcaccaacccttgggtgctgtctgagatcgagcctggtgccgctgccgtggtgggcacttttgagatcaagccagagttccttctcaaggctttgactggtcaagagggaggaccaaagggcaagctgccattgactgttcctgcttccatgcaggcgattgctgattcccctcgcgatatcccaggcaagttcctcgatgagtcttacacctacgtggactccgcagggatggcctacaagtacggtcacggacttaatttctagattgtaggtagtctcgtggg

SEQ ID NO: 470 - protein, 188 aa, Corynebacterium glutamicum
VLPLDPAASLKIYPLVTGRTKIDEVQLQLEAAIRAELPGVTLVSSESEADLAIVWARPEIALFEDDLEGVSLSVDPRANGVDVERVQAVEAAVPTILAVNFTNPWVLSEIEPGAAAVVGTFEIKPEFLLKALTGQEGGPKGKLPLTVPASMQAIADSPRDIPGKFLDESYTYVDSAGMAYKYGHGLNF

SEQ ID NO: 471 - DNA, 1062 bp, Corynebacterium glutamicum
  CDS (101)..(1039): RXN00401
cttttaagcatttcaacatgccaaactaatcttggacaggtatcactggctcctcttagactccaaagtgtcttagaaaacactcacccaaggagccctcatggcacgcttttcaccacaagatctcgcagaccacctcaaggatggactgctctctttcccggccaccgctttccaagatgacctcgaagtagatgaagctgcttatgtcgagcacattgaatggcagtccagctacccagtcgccggcctcttcgcagctggcggtactggcgaaggattcagccttaccgttgaggaaaaccaccgtgtcactcaacttgcagttcaggcgtccagcccggaagttcccgtgttggggtctgctactggctcaactaagtctgccatcgcaaacgcacagggcgcagaggcagcaggcgctgaaggtgtcctcctgcttcctccctacctcaccgaatgcgacgcagaaggcctgtacaaccatgcagccgcagtctgtgaatccacttctcttggtgtcatcgtgtacaaccgtgccaatgccatctactccccagaggttatcgctcgactctctgagcgctaccccaacttcattggatttaaagatggcaccggaaacatcgagcacctagcaaagatcaccacgctatgcggagatcgcctgttctacctcggtggacttcccaccgctgagacctttgcactaccactgcttcagatgggcatgagcacctactcctctgcaatgttcaacttcattccagatttcgcactgagcttctacgccgatgttcgtgcgcaggacagcgcagcagtaaagcagaagctgagcgattttgtgctcccctacttggatatccgcgatcgcgcacaaggctacggtgtctccattggtaagggcggactcaaggctgttggccgcaacgctggcggcgttcgcccaccactgcgtaacctttccgagcaagatatcgcggacctgtcggatttgcttgccacctctggcgcaggttcctaccgccttcagttgaggtgaaagcatgatcaccgcaaccg

SEQ ID NO: 472 - protein, 313 aa, Corynebacterium glutamicum
MARFSPQDLADHLKDGLLSFPATAFQDDLEVDEAAYVEHIEWQSSYPVAGLFAAGGTGEGFSLTVEENHRVTQLAVQASSPEVPVLGSATGSTKSAIANAQGAEAAGAEGVLLLPPYLTECDAEGLYNHAAAVCESTSLGVIVYNRANAIYSPEVIARLSERYPNFIGFKDGTGNIEHLAKITTLCGDRLFYLGGLPTAETFALPLLQMGMSTYSSAMFNFIPDFALSFYADVRAQDSAAVKQKLSDFVLPYLDIRDRAQGYGVSIGKGGLKAVGRNAGGVRPPLRNLSEQDIADLSDLLATSGAGSYRLQLR

SEQ ID NO: 473 - DNA, 924 bp, Corynebacterium glutamicum
  CDS (101)..(901): RXN02125
gacctaaaattcatcacctcaccgtttttaaggcttagaaaaatagcagtgttgggatgtgaatatccatttatgctgctgtagtcggctatgtggacgcatggtggcaacctctcagtttatcgatgacagcgaggctgcccaggcggtacgcgcagctattgttgcaggataccgaaacattgatactgccctagcgtatggaaacgagcgcggcgttggcgaaggcattcgcaccgctggagtgccccgcgaggagctctttatttccaccaagctagctgcagaaatcaaagattacgatggagcagtcgccgcgattgatgagtctttggcgaaaattggcttggattatgtcgatctgatgctcattcactccccacaaccatggagtgatttccgtggtggggactattcagagggaaaccgtgaagcgtggcgcgcgctggaagatgcctacaaagccggaaagattcgatccattggtgtctcgaacttcctggaggccgatctggagaatatcttagactccgcgacggttgctcctcacgttaatcagcttcttgtgcatgttggaaacaccccaagcgagttaatcagtttctgcgattccaagggcattctggtcgaagcatattcacccatcgcccacggagagatgctgaagaaccagcaggtcaaggcgattgctgacaagtacaacgtgagcattccgcagctatgcattcggtacacaattcaactgggaacggtgtctttgccaaagactgccaacccagatcatatgagctccaatgcgcagatcgactttgaaatttccgaggaagacatggcggcacttcaagaagtgaccgcccgcgattatggcgagcacagcggttttcctgtgtattccggcaagtagaaagatttttatcatgggac

SEQ ID NO: 474 - protein, 267 aa, Corynebacterium glutamicum
MVATSQFIDDSEAAQAVRAAIVAGYRNIDTALAYGNERGVGEGIRTAGVPREELFISTKLAAEIKDYDGAVAAIDESLAKIGLDYVDLMLIHSPQPWSDFRGGDYSEGNREAWRALEDAYKAGKIRSIGVSNFLEADLENILDSATVAPHVNQLLVHVGNTPSELISFCDSKGILVEAYSPIAHGEMLKNQQVKAIADKYNVSIPQLCIRYTIQLGTVSLPKTANPDHMSSNAQIDFEISEEDMAALQEVTARDYGEHSGFPVYSGK

SEQ ID NO: 475 - DNA, 3561 bp, Corynebacterium glutamicum
  CDS (101)..(3538): RXN00200
aacccggagtcatttgatcagatgtggcagaccaagcaagtgggacctttcgtggtggtaacgcacaatgagtaattcctcaccaaacgacccaagccctatgcgccaagtcggtggtaatgggggccatcaactagactcgatcaacgtgtcagatgtagttgagtcgaagaaactaaagggttctgcgcaagaacccccgcaggttgccccgggctggctgaagaaactggctatctcatcaggtctgcttggcctgttgatgtttgtgctgttgcctttcctgccagtgaaccaggtgcagtcttcgctgtcatggccacaaaatggtgagctttccagcgttaacgccccgctgatttcctacgcaccgcagtcgatggatgcgtccatccctgtgtccgcgctggacagtctcaatgacaatcagtcgttggtgatgggcacgttgcctctggacagtacggacgccaccaaccgtggtctgtttgtgcgcaccatcgacggtaaccttgacgtgattgttcgcggtgaggtgctgttggatctttcaccaacagaggtgaaccgtctgccagatgatgcgatcctagagatttcctccaccgaggaaaccaccagcgcggaaatcaccggcacggcattcagcggcgagaccgaaggcgatgagcggcctcaggtcaccggcgtttacaccgagcttgtcgacgacccctccaccgcatcggccctggcctcagcgggcttaaacgttgatattgagatcaactcccgcttcacttcatcccccagccttctaaagtacgcagccatcttcattggccttgcgtctgtgttggtctccctgtggacactgcaccgcatggatattttggatggtcgaaaagcacaccgcttcctgcctgccaactggtacaagctgaagccacttgatggtgttgtcgtagcgattttggtgttctggcacttccttggcgccaacacctctgacgacggcttcatcatgaccatggcccgcgtgtcccagaacgcggattatatggccaactactaccgctggttcggtgtcccagaatcaccattcggcgcaccatattacgacttgctggctctgatggcctacatctcaacctcatcaatctggcttcgtctacccgcattgctcgctggactgatcatgtggttcgtgatcaccagagaggtcatgccacggtttggctcattggttaacggtcgccgcgttgcgcactggtctgcagccatggtgttcctggcgttctggcttccatacaacaacggcactcgcccagagccaatcatcgcgatgggagctctacttgcgtgggtttccttcgagcgcgctatcgctacctccaggttgttgcccgctgccattggtgtcattatcgccaccatttccctggcatcaggccccaccggtctaatggcagttgctgcgttgctggtcagtttgtccgcgttgattcgcattctttataggcgcttgccgcttattggggcgtcgaggggggcgtcgaaaagcaaagtctttggcgcttcgatggctatgcttgccccattccttgcgtctggcaccgcgattctcatcgccgtttttggcgatcagactctgtcaaccgtcatggaatccatcagcgtgcgctccgcgaagggcccggcactgacctggtaccacgaatatgtgcgctaccaaaccgtcatggaacaaaccgttgatggttccttcacccgccgttttgctgtgctgatgctcatggcgtgtctggctattgtggtcatcgcgatcctgcgttacggccgcattccaggcgctgcgaagggaccatcactgcgtttgatgatggtcattttcggcaccatgttcttcatgatgttcaccccaaccaagtggactcaccacttcggtgtctacgcaggacttgccggcgcattggccggacttgctgccgtggggctgtcctatgttgcggtgaaatcaccacgcatgcgcaccatttccatcggtgcgttcctcttcctgctggcgctggctctcgcaggcgtgaacggattctggtacacctccagctacgccgtgccatggtgggataaaaccatccagatcaagggcatcgaagcatccaccgtagtgctcgtgatcgccgtgatcgtgctgatcatcggtgttattcaatcctttgtccacgatgtgaaaaccgcgcaagccgaaaccaatcactccatgggcgaactcgtggcggaagatgaagcaaagcgcgagcgtgcctccaggttcaccggccttgcggcctcccctatcgcaggagtgtccgccctcgttgtgctgattacctgcgcatccatgggcaaaggctttgtggaccaataccccgcgtactccgtgggtcttggcaacctccgctccctgaccggcaacacatgtggccttgcctccgacgccatgctggaaaccaactccaacgattccttcctcactccagtgaactccacacttggcgagtccctggaatccgaagatattcgcggctttagtgctgccggcatcccaccatcaatcagccaggaccaagcagacctgtctgctgttggtgccattgccaacactgacgactccaccgaaaccggcggatccgacgaatcatccggacaatccaccggcaacaccggcggtgtccgaggctccgaaggcatcaacggctccaacgcccgcctgccattcaacctggactacacccaagttccagtcgtcggctcctggtccgctggcacccaaaacccagcaaacatcaccaccgactggtacgaaatcccagaagccaccgaagaagcacccatcatcgtggtatctgcagcaggtcgcatcgaacactacgacatcaacggcgtccgccaatccggacaatccgtcatgctcgaatacggtcgccttcgcgataacggcgacgttgaagacctcggcgaagccatgatgtacgacatcggccccgagccatcctggcgcaacctccgctacccacttgaccaactcccagaagaagcggacgtcgtgcgcatcgtcgccaccgacgtcaacctcgacgaagaccaatgggtagcactgacgccaccacgcgtacctaacctagattctctgaacaacgtcatcggatccgaaaccccaggactcctcgactgggcagttggcctgcaattcccatgccaacgcaccttcgaccactacgccggagtcaccgagattcctgaataccgaatctccccagaccacggcggaaaatccaccctctccccattccaagactgggcaggcggcggatccatgggcacggccgaagcagtaaacaacgcctacgaaatcccgtcctacctccgcaacgactggggccgcgactggggttccatcgaacgctactcgctgcgcaccaactccaacggcgatgcacctaaggttgcagacatcaaccttgaaaccatccaacgttccggactctggaatccagggcatatgaaggtagatgaataagaccttcagtactggaagtt

SEQ ID NO: 476 - protein, 1146 aa, Corynebacterium glutamicum
MRQVGGNGGHQLDSINVSDVVESKKLKGSAQEPPQVAPGWLKKLAISSGLLGLLMFVLLPFLPVNQVQSSLSWPQNGELSSVNAPLISYAPQSMDASIPVSALDSLNDNQSLVMGTLPLDSTDATNRGLFVRTIDGNLDVIVRGEVLLDLSPTEVNRLPDDAILEISSTEETTSAEITGTAFSGETEGDERPQVTGVYTELVDDPSTASALASAGLNVDIEINSRFTSSPSLLKYAAIFIGLASVLVSLWTLHRMDILDGRKAHRFLPANWYKLKPLDGVVVAILVFWHFLGANTSDDGFIMTMARVSQNADYMANYYRWFGVPESPFGAPYYDLLALMAYISTSSIWLRLPALLAGLIMWFVITREVMPRFGSLVNGRRVAHWSAAMVFLAFWLPYNNGTRPEPIIAMGALLAWVSFERAIATSRLLPAAIGVIIATISLASGPTGLMAVAALLVSLSALIRILYRRLPLIGASRGASKSKVFGASMAMLAPFLASGTAILIAVFGDQTLSTVMESISVRSAKGPALTWYHEYVRYQTVMEQTVDGSFTRRFAVLMLMACLAIVVIAILRYGRIPGAAKGPSLRLMMVIFGTMFFMMFTPTKWTHHFGVYAGLAGALAGLAAVGLSYVAVKSPRMRTISIGAFLFLLALALAGVNGFWYTSSYAVPWWDKTIQIKGIEASTVVLVIAVIVLIIGVIQSFVHDVKTAQAETNHSMGELVAEDEAKRERASRFTGLAASPIAGVSALVVLITCASMGKGFVDQYPAYSVGLGNLRSLTGNTCGLASDAMLETNSNDSFLTPVNSTLGESLESEDIRGFSAAGIPPSISQDQADLSAVGAIANTDDSTETGGSDESSGQSTGNTGGVRGSEGINGSNARLPFNLDYTQVPVVGSWSAGTQNPANITTDWYEIPEATEEAPIIVVSAAGRIEHYDINGVRQSGQSVMLEYGRLRDNGDVEDLGEAMMYDIGPEPSWRNLRYPLDQLPEEADVVRIVATDVNLDEDQWVALTPPRVPNLDSLNNVIGSETPGLLDWAVGLQFPCQRTFDHYAGVTEIPEYRISPDHGGKSTLSPFQDWAGGGSMGTAEAVNNAYEIPSYLRNDWGRDWGSIERYSLRTNSNGDAPKVADINLETIQRSGLWNPGHMKVDE

SEQ ID NO: 477 - DNA, 1509 bp, Corynebacterium glutamicum
  CDS (101)..(1486): RXN01175
tcgcgtctcttagtcgatctgctcccattccataggttgggagaaaacttaactgttattccattccttaaaacaccgatatcgtgctatgaataggggtgtgagttggacagttgatatccctaaagaagttctccctgatttgccaccattgccagaaggcatgcagcagcagttcgaggacaccatttcccgtgacgctaagcagcaacctacgtgggatcgtgcacaggcagaaaacgtgcgcaagatccttgagtcggttcctccaatcgttgttgcccctgaggtacttgagctgaagcagaagcttgctgatgttgccaacggtaaggccttcctcttgcagggtggtgactgtgcggaaactttcgagtcaaacactgagccgcacattcgcgccaacgtaaagactctgctgcagatggcagttgttttgacctacggtgcatccactcctgtgatcaagatggctcgtattgctggtcagtacgcaaagcctcgctcttctgatctggatggaaatggtctgccaaactaccgtggcgatatcgtcaacggtgtggaggcaaccccagaggctcgtcgccacgatcctgcccgcatgatccgtgcttacgctaacgcttctgctgcgatgaacttggtgcgcgcgctcaccagctctggcaccgctgatctttaccgtctcagcgagtggaaccgcgagttcgttgcgaactccccagctggtgcacgctacgaggctcttgctcgtgagatcgactccggtctgcgcttcatggaagcatgtggcgtgtccgatgagtccctgcgtgctgcagatatctactgctcccacgaggctttgctggtggattacgagcgttccatgctgcgtcttgcaaccgatgaggaaggcaacgaggaactttacgatctttcagctcaccagctgtggatcggcgagcgcacccgtggcatggatgatttccatgtgaacttcgcatccatgatctctaacccaatcggcatcaagattggtcctggtatcacccctgaagaggctgttgcatacgctgacaagctcgatccgaacttcgagcctggccgtttgaccatcgttgctcgcatgggccacgacaaggttcgctccgtacttcctggtgttatccaggctgttgaggcatccggacacaaggttatttggcagtccgatccgatgcacggcaacactttcaccgcatccaatggctacaagacccgtcacttcgacaaggttatcgatgaggtccagggcttcttcgaggtccaccgcgcattgggcacccacccaggcggaatccacattgagttcactggtgaagatgtcaccgagtgcctcggtggcgctgaagacatcaccgatgttgatctgccaggccgctacgagtccgcatgcgatcctcgcctgaacactcagcagtctttggagttggctttcctcgttgcagaaatgctgcgtaactaagcttttagaccaactctaaa

SEQ ID NO: 478 - protein, 462 aa, Corynebacterium glutamicum
VSWTVDIPKEVLPDLPPLPEGMQQQFEDTISRDAKQQPTWDRAQAENVRKILESVPPIVVAPEVLELKQKLADVANGKAFLLQGGDCAETFESNTEPHIRANVKTLLQMAVVLTYGASTPVIKMARIAGQYAKPRSSDLDGNGLPNYRGDIVNGVEATPEARRHDPARMIRAYANASAAMNLVRALTSSGTADLYRLSEWNREFVANSPAGARYEALAREIDSGLRFMEACGVSDESLRAADIYCSHEALLVDYERSMLRLATDEEGNEELYDLSAHQLWIGERTRGMDDFHVNFASMISNPIGIKIGPGITPEEAVAYADKLDPNFEPGRLTIVARMGHDKVRSVLPGVIQAVEASGHKVIWQSDPMHGNTFTASNGYKTRHFDKVIDEVQGFFEVHRALGTHPGGIHIEFTGEDVTECLGGAEDITDVDLPGRYESACDPRLNTQQSLELAFLVAEMLRN

SEQ ID NO: 479 - DNA, 984 bp, Corynebacterium glutamicum
  CDS (101)..(961): RXN01376
tcctcatcggttatcgggagtggcggatacttcttgcaaacttaaaccactatgctttcgcttcgtgagtactttgaaatcccccatcgctgtgatcacagtgacctattcaccaggtaaatacttggcgtcgttcctggattctttgcctggtgcgacttcacgagacacccacgttgtgatggcagacaatggttctgtggacggtgttcctgagcaggcagcagcctcacgcagcaacgtggagttcctctcaactggcggcaacttaggctacggaacggctattaatattgccgcccgatcgttgcgtgcgcgccgggaggcaggagagatcgatggggagttcttcctcgtctcaaaccctgatgttgtttttgacgaagactctattgatcaattgcttgaatgtgcgaaacgtcaccctgaagcaggagcggttggcccgttgatccgtgaggcggacggttcggcgtatccgtcggctcgggcggtacccactttggcgaatggcattggtcacgctttgttgggtgctgtgtggaaatccaatccgtggtcggcggcttaccgtgacgatgaagatatggacactgagcgcactgctggctggctgtcgggatcgtgcctgttattaaggtgggatgcgtttgatcgagttggtggttttgatgagcgctacttcatgtacatggaagacgttgacctgggagatcggctggttcgcgccggtttcaccaacgtcttttgcccaagtgcgcagatcatccacgcgaaaggtcatgttgcgggtaaaaacccagagaacatgttgcccgcacaccacgagagcgcgtatcgcttccaggctgatcgcctcgcgaagccgtggcaagccccaattcggttggctctgcgaattggtttgaaattacgagccggagtcgcggttggtgtctctaagatgagaacgaaagcctcttagaccgtcgacgaccaccggac

SEQ ID NO: 480 - protein, 287 aa, Corynebacterium glutamicum
VTYSPGKYLASFLDSLPGATSRDTHVVMADNGSVDGVPEQAAASRSNVEFLSTGGNLGYGTAINIAARSLRARREAGEIDGEFFLVSNPDVVFDEDSIDQLLECAKRHPEAGAVGPLIREADGSAYPSARAVPTLANGIGHALLGAVWKSNPWSAAYRDDEDMDTERTAGWLSGSCLLLRWDAFDRVGGFDERYFMYMEDVDLGDRLVRAGFTNVFCPSAQIIHAKGHVAGKNPENMLPAHHESAYRFQADRLAKPWQAPIRLALRIGLKLRAGVAVGVSKMRTKAS

SEQ ID NO: 481 - DNA, 1002 bp, Corynebacterium glutamicum
  CDS (101)..(979): RXN01631
gccagttgaggatgctctcacagtcgctcgcattgtcagtgcatgctacgaatccgacaacaaccagggcatttccgtaaacatctaagaggagcactccatgaaaccacaacttattgcatcttgctggaccagcgcgggagacgccgcacccgatcgtgacgatctcagcagcccagtagcaatcgatgagcgcatcgctctagtcgctgaaaccggttgggcaggcattgggcttgttcacgccgatctcatcaaagcacgcgacaccattggctacgaggaattgcgccgacgcatccacgctgcaggaattgaaatcattgaggtggagttcctcaatggttggtgggcgactggtgcggaacgccaagagtccgatgccgttcgtgcggatctgtttgctgcggcgcaagctcttggttccccacacattaaggtcggagcaggagagggcaccaatggtgtggttcccattgctcacatggccagtgcgtttactgatctcgctgcggaagctgaagctcatggcgtcaagctcgcgttggaagcaactccgttttctcacctgaagaccatctacgacgcgctggaagttgtcagccattccgatagcccatcggctggactcatggttgatatctggcacaccgcgaaaatcggaatccccaacgatgaactgtggcgcaacattccactgtccaaggtcaacgcagtggaggttgatgatggtttcattgacaccccaattgatcttttcgatgactccaccaaccgtcgcgcgtactgcggtgaaggcgaatttgatcccgcaagcttcatccgtggcgccatcgacgccggttggacgggcgcatatggtgtggaaattatttccgcagagcaccgaagcctcccggtgaaagaagggctgcaacgtgctttcgacaccaccatcgcagcgtttgaacaagctgctcgtctcgccccctccactaactgatctttgaaaggctgaaaaaa

SEQ ID NO: 482 - protein, 293 aa, Corynebacterium glutamicum
MKPQLIASCWTSAGDAAPDRDDLSSPVAIDERIALVAETGWAGIGLVHADLIKARDTIGYEELRRRIHAAGIEIIEVEFLNGWWATGAERQESDAVRADLFAAAQALGSPHIKVGAGEGTNGVVPIAHMASAFTDLAAEAEAHGVKLALEATPFSHLKTIYDALEVVSHSDSPSAGLMVDIWHTAKIGIPNDELWRNIPLSKVNAVEVDDGFIDTPIDLFDDSTNRRAYCGEGEFDPASFIRGAIDAGWTGAYGVEIISAEHRSLPVKEGLQRAFDTTIAAFEQAARLAPSTN

SEQ ID NO: 483 - DNA, 990 bp, Corynebacterium glutamicum
  CDS (101)..(967): RXN01593
atatgacagccttcttcttgatctagatggaaccgtctacgagggcggccgagccattgagcacgtagtttctgcgctctctggcgccggcctacccgtcatgtatgtcaccaataatgcctcccgtgctccggaggtggtggctgcgcaactccgtgagattggccttgccgacaccactgcggacaatgtgatgacatctgctcaagctgcctgcaagatggcggcggagaagattcccgctggatccaaggtgtatgttttgggttcagaatccttccgcgagctagctactgaagctggttttgtggtggttgattcggctgatgataaacctgtggctgtgcttcacggccacaaccctgagaccggttgggctcagttgagcgaggctgcgctgtcaattaatgctggcgcgcagtattttgcatcaaatttggattccacccttcccatggaacgcggtcgtcacattggcaacggttccatggtggctgccgtggtcaacgcgactggcgtaaagcctctttccgcaggtaagccaggccccgcgatgttctatgcgggggctgaaactcttaattcttcaaagcctttggctgtcggcgatcgtctcgataccgatatcgccggcggaaacgctgcaggcatggacacattccaggtcctgaccggcgtcagcggctactacgatttggtgcgcgccattcccagagcagcgccccacctatatcgccacctcgatgcaggatctctacagcgatccgggcgagctcaagccaggtgcccagggcggtttttcagcgcttatcgacggcgacaccctggtcatttccggcggcgatgccggcgcaactccggttgcagcactccgcactgcgttggatgtggcctgggcggccacagagcagtcaccgaggtacgcgctgattcagaggtagctgctactgcattgcagagctggtggtaaacggtgaattcaccaaagcc

SEQ ID NO: 484 - protein, 289 aa, Corynebacterium glutamicum
MYVTNNASRAPEVVAAQLREIGLADTTADNVMTSAQAACKMAAEKIPAGSKVYVLGSESFRELATEAGFVVVDSADDKPVAVLHGHNPETGWAQLSEAALSINAGAQYFASNLDSTLPMERGRHIGNGSMVAAVVNATGVKPLSAGKPGPAMFYAGAETLNSSKPLAVGDRLDTDIAGGNAAGMDTFQVLTGVSGYYDLVRAIPRAAPHLYRHLDAGSLQRSGRAQARCPGRFFSAYRRRHPGHFRRRCRRNSGCSTPHCVGCGLGGHRAVTEVRADSEVAATALQSWW

SEQ ID NO: 485 - DNA, 1173 bp, Corynebacterium glutamicum
  CDS (101)..(1150): RXN00337
ggacgcttattggtgagcattcggattacgccggtggtgtggtgctggcggctaatgcgaattgccggactgcggctgccgtcaataaagaaccgcgacgatgttgttaacgtatgcgtttgtggatgtggagggaggcgtcgaaaagcattctttaagcactgcggacattgcagctcgcgcacacgcccatatgaaatcccatgatgttttggggcggcagactacgccgcctcagccggagggcggcgttgctgcccggttgggcgggattgcgtggacaatgatccataagcaaatgctttcgcgtgacacaaaaggcctggatatcaccgtgttgagcaccattcctgagggggtggggctgggtgaaaattccgccatggatgtggcgctcgcattggcgctgtatcgggaaaatattgaggaagcccccacgaaggcgcgcattgcggagatttgttcgcagtccgcattcatgttcagtgagacttcagtgttgcgtgcgcggcacaccgtggcgttgcggggtgaaactggacagatttcggtggttgattacgccgatggttcggtcactcaggcgccacatccggtgagtcgttccgctggtttgtcggcatttgttgttgctgcgcaaactgaaactgatccgagcatttaccgcgagatctatgctcgacatgcgtttatcgatgaagctgcgcgcgctttcagtgtggaatctttgcggttgcttcccgacgcttccactcgtgttgtggattggttgcaggccgtgattgaggtgactggtcgagaggatctgccctcgattgaacaagcccagcgctggttgaatctgtgggaaaacgaaacccggcgcgctcagaggacagccaatgccctgcgttcgagaaggctgagtgagttttctgagctgctgatggaatcccaagatgatttgagcgacaccttcgatttcccccctgctgatttggcgcttgctcgtttgtgcgtcgagcggggtgccacagctgctcggtccacgtcagcgcgcggtgtgattgcgttggttgatgcccatcatgcgcacaattttgctgcggatctcagcgaggatggcttgttggtggttcctctcgggcacggggacgtcgcggaacagggctagcacgcctacttaaccagcct

SEQ ID NO: 486 - protein, 350 aa, Corynebacterium glutamicum
MLLTYAFVDVEGGVEKHSLSTADIAARAHAHMKSHDVLGRQTTPPQPEGGVAARLGGIAWTMIHKQMLSRDTKGLDITVLSTIPEGVGLGENSAMDVALALALYRENIEEAPTKARIAEICSQSAFMFSETSVLRARHTVALRGETGQISVVDYADGSVTQAPHPVSRSAGLSAFVVAAQTETDPSIYREIYARHAFIDEAARAFSVESLRLLPDASTRVVDWLQAVIEVTGREDLPSIEQAQRWLNLWENETRRAQRTANALRSRRLSEFSELLMESQDDLSDTFDFPPADLALARLCVERGATAARSTSARGVIALVDAHHAHNFAADLSEDGLLVVPLGHGDVAEQG

SEQ ID NO: 487 - DNA, 1248 bp, Corynebacterium glutamicum
  CDS (101)..(1225): RXS00584
tagttgtgccacctaaaacgcgaacagaaccggagtcgagcagcacctccccgcaagggtagaggggctgcttttttgtttcctaaattcaccccatcccatgcatagccctgaaaggcaagaaaaaatgagttctccagtctcactcgaaaacgcggcgtcaaccagcaacaagcgcgtcgtggctttccacgagctgcctagccctacagatctcatcgccgcaaacccactgacaccaaagcaggcttccaaggtggagcaggatcgccaggacatcgctgatatcttcgctggcgacgatgaccgcctcgttgtcgttgtgggaccttgctcagttcacgatcctgaagcagccatcgattacgcaaaccgcctggctccgctggcaaagcgccttgatcaggacctcaagattgtcatgcgcgtgtacttcgagaagcctcgcaccatcgtcggatggaagggattgatcaatgatcctcacctcaacgaaacctacgacatcccagagggcttgcgcattgcgcgcaaagtgcttatcgacgttgtgaaccttgatctcccagtcggctgcgaattcctcgaaccaaacagccctcagtactacgccgacactgtcgcatggggagcaatcggcgctcgtaccaccgaatctcaggtgcaccgccagctggcttctgggatgtctatgccaattggtttcaagaacggaactgacggaaacatccaggttgcagtcgacgcggtacaggctgcccagaacccacacttcttcttcggaacctccgacgacggcgcgctgagcgtcgtggagaccgcaggcaacagcaactcccacatcattttgcgcggcggtacctccggcccgaatcatgatgcagcttcggtggaggccgtcgtcgagaagcttggtgaaaacgctcgtctcatgatcgatgcttcccatgctaactccggcaaggatcatatccgacaggttgaggttgttcgtgaaatcgcagagcagatttctggcggttctgaagctgtggctggaatcatgattgagtccttcctcgttggtggcgcacagaaccttgatcctgcgaaattgcgcatcaatggcggtgaaggcctggtgtacggacagtctgtgaccgataagtgcatcgatattgacaccaccatcgatttgctcgctgagctggccgcagcagtaagggaacgccgagcagcagccaagtaattaagggcgctagactgtta

SEQ ID NO: 488 - protein, 375 aa, Corynebacterium glutamicum
MHSPERQEKMSSPVSLENAASTSNKRVVAFHELPSPTDLIAANPLTPKQASKVEQDRQDIADIFAGDDDRLVVVVGPCSVHDPEAAIDYANRLAPLAKRLDQDLKIVMRVYFEKPRTIVGWKGLINDPHLNETYDIPEGLRIARKVLIDVVNLDLPVGCEFLEPNSPQYYADTVAWGAIGARTTESQVHRQLASGMSMPIGFKNGTDGNIQVAVDAVQAAQNPHFFFGTSDDGALSVVETAGNSNSHIILRGGTSGPNHDAASVEAVVEKLGENARLMIDASHANSGKDHIRQVEVVREIAEQISGGSEAVAGIMIESFLVGGAQNLDPAKLRINGGEGLVYGQSVTDKCIDIDTTIDLLAELAAAVRERRAAAK

SEQ ID NO: 489 - DNA, 1131 bp, Corynebacterium glutamicum
  CDS (101)..(1108): RXS02574
tgtgctccttgcgggctgcgcagaagagccggaacagcaaaaagcaataagccgcttatcgacgtccccctccacccctcccgcaccgaccgcggaggatttggcgcgcgcgcaaatccctgaacagcaacgcgaccaagtcgcgtcgctgatgatggttggagttgcgaattatgatcaggcattggatgcgctcaatcagggggtgggtggcatctttattggttcctggacagatgaaaatctgctcacggaacctggccgtaatattgaggcgctccgcgaagccgtcggcagggatttctccgtcagcatcgacttcgaaggcggccgcgtccagcgtgccaccaatattcttggtgatttcccctcaccgcgcgtgatggcgcaaaccatgacgccggaacaagtagaagatctcgcagaaatcctaggcactggtttagctgcacatggtgtgacagttaactttgcacctgttgtagatgtagatgcttggggtctccccgtcgttggcgatcgttccttttccaacgacccagccgtagcagctacttatgccacagcttttgcaaagggcttaagcaaagtaggaattaccccagtattcaaacatttcccaggtcacggtcgtgcaagtggcgattcgcacacccaagatgtggtgacccccgcacttgatgagcttaaaacttacgacctcatcccttatggtcaagcactttctgaaactgacggagccgtcatggtgggccacatgattgttccaggtcttggcaccgacggagttccatcctctatcgaccccgccacctatcaactgctccgcagtggcgattacccaggtggcgtgcctttcgatggcgtgatctacaccgacgatctctctggaatgagtgccatttccgccacccattcacccgcagaagcagtgcttgcctccctcaaagcaggcgcagaccaagcactatggatcgactatgggtcgttgggctccgcgattgatcgcgttgatgctgccgttagcagcggtgaataccctcaagaacaaatgctggcatctgcgttaagagtccaattgctctacatcacacgtctcgaacaaaagtgaagttaccagtccgtaacccc

SEQ ID NO: 490 - protein, 336 aa, Corynebacterium glutamicum
LARAQIPEQQRDQVASLMMVGVANYDQALDALNQGVGGIFIGSWTDENLLTEPGRNIEALREAVGRDFSVSIDFEGGRVQRATNILGDFPSPRVMAQTMTPEQVEDLAEILGTGLAAHGVTVNFAPVVDVDAWGLPVVGDRSFSNDPAVAATYATAFAKGLSKVGITPVFKHFPGHGRASGDSHTQDVVTPALDELKTYDLIPYGQALSETDGAVMVGHMIVPGLGTDGVPSSIDPATYQLLRSGDYPGGVPFDGVIYTDDLSGMSAISATHSPAEAVLASLKAGADQALWIDYGSLGSAIDRVDAAVSSGEYPQEQMLASALRVQLLYITRLEQK

SEQ ID NO: 491 - DNA, 1038 bp, Corynebacterium glutamicum
  CDS (1)..(1008): RXS03215
atcgatgttgtcagcgtcgtggtggctaacttcctgcaccgcgaaatcgtggaagcacttctggcatccggcaagcatgtgctgtgcgagaagccactgtcagacaccatcgaagatgcagaagccatgattgaggcagccggccgtgcagcaacaaatggcaccatcgcccgcatcggactgacctaccgccgttccccaggcgtggcacacatccgtgatctcgtgcagtccggcgagcttggcaaggttctacacgtcaccggccactactggaccgactacggatccaatgcacaggcaccaatcagctggcgttacaaggggccaaacggctccggcgcactggcagatgtgggaagccacctcacctacctggcagaattcgttgcaggatctgacttcgccgccgtccgtggtggccagttgtccaccgtgatcaccgagcgccccaagccactcggcgcgattgtcggccacgaaggcggcgcagtttccgatgaatacgaagcagtggaaaatgatgacattgcatcattctccggatccttcatcggtggcggaaccgcaaccctccaggtcagccgcatttcccagggacacccaaacaccctaggttttgaagtgttctgtgaaaagggctccgtgctctttgatttccgcaactcaggcgaattcaaaatcttcaccccagcaacctccggtgacatcagccaagaagccggctaccgcaccatcaccatcggaccaaagcacccatactggcgcggcggccttgcaatggatgcaccaggcgtgggaattggccaaaacgaaggcttcgttttccaggcgcgcgcattcctcgaagaaatcgcaggaatctccgaagctgaaagcctgccacgctgcgcaactttggaagaagggctacacaatatgcagctcattgatgctgtatcacagtcagctgcagcaggtggcgaaaccgttgcggtcccagcggctgctctgatccctgcaaacaactagaaactattcagaaagcatcaccatgaa

SEQ ID NO: 492 - protein, 336 aa, Corynebacterium glutamicum
IDVVSVVVANFLHREIVEALLASGKHVLCEKPLSDTIEDAEAMIEAAGRAATNGTIARIGLTYRRSPGVAHIRDLVQSGELGKVLHVTGHYWTDYGSNAQAPISWRYKGPNGSGALADVGSHLTYLAEFVAGSDFAAVRGGQLSTVITERPKPLGAIVGHEGGAVSDEYEAVENDDIASFSGSFIGGGTATLQVSRISQGHPNTLGFEVFCEKGSVLFDFRNSGEFKIFTPATSGDISQEAGYRTITIGPKHPYWRGGLAMDAPGVGIGQNEGFVFQARAFLEEIAGISEAESLPRCATLEEGLHNMQLIDAVSQSAAAGGETVAVPAAALIPANN

SEQ ID NO: 493 - DNA, 1031 bp, Corynebacterium glutamicum
  CDS (1)..(1008): FRXA01915
atcgatgttgtcagcgtcgtggtggctaacttcctgcaccgcgaaatcgtggaagcacttctggcatccggcaagcatgtgctgtgcgagaagccactgtcagacaccatcgaagatgcagaagccatgattgaggcagccggccgtgcagcaacaaatggcaccatcgcccgcatcggactgacctaccgccgttccccaggcgtggcacacatccgtgatctcgtgcagtccggcgagcttggcaaggttctacacgtcaccggccactactggaccgactacggatccaatgcacaggcaccaatcagctggcgttacaaggggccaaacggctccggcgcactggcagatgtgggaagccacctcacctacctggcagaattcgttgcaggatctgacttcgccgccgtccgtggtggccagttgtccaccgtgatcaccgagcgccccaagccactcggcgcgattgtcggccacgaaggcggcgcagtttccgatgaatacgaagcagtggaaaatgatgacattgcatcattctccggatccttcatcggtggcggaaccgcaaccctccaggtcagccgcatttcccagggacacccaaacaccctaggttttgaagtgttctgtgaaaagggctccgtgctctttgatttccgcaactcaggcgaattcaaaatcttcaccccagcaacctccggtgacatcagccaagaagccggctaccgcaccatcaccatcggaccaaagcacccatactggcgcggcggccttgcaatggatgcaccaggcgtgggaattggccaaaacgaaggcttcgttttccaggcgcgcgcattcctcgaagaaatcgcaggaatctccgaagctgaaagcctgccacgctgcgcaactttggaagaagggctacacaatatgcagctcattgatgctgtatcacagtcagctgcagcaggtggcgaaaccgttgcggtcccagcggctgctctgatccctgcaaacaactagaaactattcagaaagcatca

SEQ ID NO: 494 - protein, 336 aa, Corynebacterium glutamicum; identical to SEQ ID NO: 492

SEQ ID NO: 495 - DNA, 1288 bp, Corynebacterium glutamicum
  CDS (101)..(1258): RXS03224
acgattgtgctgtcgtttgcgttggtgaatagttctggaccgggtattttgcggcgcacatggaactcattgaacgccgcgcccggctaaggtgggaggcatgagttttgctgaacatgcgatcatctggcacgtctaccccctgggcgctttgggtgctcccatccggcctgaagcccccgcacctgtcacacatcggctccccaatctaattgggtggctggattatgttgtcgaactaggctgcaacgccctcatgctgggaccggtattcgagtccgtcagccacggctacgacaccctcgatttctaccgcatcgacccgcgcctcggcaccgaggaagacatggacgcgctgctggaggctgcgaatcagcggggcattggagtgcttttcgacggcgtcttcaatcatgtttccagttcctctaaatatctcgacctgaccaccggggcgtcatttgaaggccacgacatcctggcggaactcgaccacacgaatcccgccgtagtggatctggttgtcgatgtcatgaaccactggctcgaccgcggaatcgcaggctggcgactcgacgctgtctacgccatcgcccctgaattttgggaaaaagtcctgccagaagtgcgacgaaaacacccacacgcatggatcgtgggggagatgatccatggagattactccgactacgtgaaaagctccggcattgattccgttaccgaatacgaactgtggaaagccatttggagcagcatcaaagagcgcaatttctttgaactcgaatggactttgagtcgccacaatgaattcctcgatactttcgtaccgcagacattcattggtaaccatgacgtcacccgcattgccacccgaatcggtcaatcaaatgcgatcctggccgcagcgatcctcttcacggtcggaggaaccccaagcatttactacggcgatgagcagggctttacgggattgaaagaggataacgttttcggtgacgatgccattaggccacctcttcctgccgagttttctccactgggcacctggattgaaaacatttataaggctctgatcgcgctgcgcaggcaacacccgtggttgtatcaggcgcacaccgaagtccttgagattgctaatgaagcgatgacctataagtccgtcggtcttggaggtgaagagctgacagtgcatcttgatttggaagaggtgtctgttcggatccttgatggcgagaaggtgctgtttcagtacagcgcttagttgtcggttcaagggtaggggaacaaa

SEQ ID NO: 496 - protein, 386 aa, Corynebacterium glutamicum
MSFAEHAIIWHVYPLGALGAPIRPEAPAPVTHRLPNLIGWLDYVVELGCNALMLGPVFESVSHGYDTLDFYRIDPRLGTEEDMDALLEAANQRGIGVLFDGVFNHVSSSSKYLDLTTGASFEGHDILAELDHTNPAVVDLVVDVMNHWLDRGIAGWRLDAVYAIAPEFWEKVLPEVRRKHPHAWIVGEMIHGDYSDYVKSSGIDSVTEYELWKAIWSSIKERNFFELEWTLSRHNEFLDTFVPQTFIGNHDVTRIATRIGQSNAILAAAILFTVGGTPSIYYGDEQGFTGLKEDNVFGDDAIRPPLPAEFSPLGTWIENIYKALIALRRQHPWLYQAHTEVLEIANEAMTYKSVGLGGEELTVHLDLEEVSVRILDGEKVLFQYSA

SEQ ID NO: 497 - DNA, 1281 bp, Corynebacterium glutamicum
  CDS (101)..(1258): FRXA00038
acgattgtgctgtcgtttgcgttggtgaatagttctggaccgggtattttgcggcgcacatggaactcattgaacgccgcgcccggctaaggtgggaggcatgagttttgctgaacatgcgatcatctggcacgtctaccccctgggcgctttgggtgctcccatccggcctgaagcccccgcacctgtcacacatcggctccccaatctaattgggtggctggattatgttgtcgaactaggctgcaacgccctcatgctgggaccggtattcgagtccgtcagccacggctacgacaccctcgatttctaccgcatcgacccgcgcctcggcaccgaggaagacatggacgcgctgctggaggctgcgaatcagcggggcattggagtgcttttcgacggcgtcttcaatcatgtttccagttcctctaaatatctcgacctgaccaccggggcgtcatttgaaggccacgacatcctggcggaactcgaccacacgaatcccgccgtagtggatctggttgtcgatgtcatgaaccactggctcgaccgcggaatcgcaggctggcgactcgacgctgtctacgccatcgcccctgaattttgggaaaaagtcctgccagaagtgcgacgaaaacacccacacgcatggatcgtgggggagatgatccatggagattactccgactacgtgaaaagctccggcattgattccgttaccgaatacgaactgtggaaagccatttggagcagcatcaaagagcgcaatttctttgaactcgaatggactttgagtcgccacaatgaattcctcgatactttcgtaccgcagacattcattggtaaccatgacgtcacccgcattgccacccgaatcggtcaatcaaatgcgatcctggccgcagcgatcctcttcacggtcggaggaaccccaagcatttactacggcgatgagcagggctttacgggattgaaagaggataacgttttcggtgacgatgccattaggccacctcttcctgccgagttttctccactgggcacctggattgaaaacatttataaggctctgatcgcgctgcgcaggcaacacccgtggttgtatcaggcgcacaccgaagtccttgagattgctaatgaagcgatgacctataagtccgtcggtcttggaggtgaagagctgacagtgcatcttgatttggaagaggtgtctgttcggatccttgatggcgagaaggtgctgtttcagtacagcgcttagttgtcggttcaagggtaggg

SEQ ID NO: 498 - protein, 386 aa, Corynebacterium glutamicum; identical to SEQ ID NO: 496

SEQ ID NO: 499 - DNA, 517 bp, Corynebacterium glutamicum
  CDS (101)..(517): RXC00233
cgcctccagcagttgagggagaagttccaacacttgcaccaactgaggaagcaactgtgcaatagcgctttagacacagactcatgacagaatagaagacatgagtgtgaatgaagcagatctgaacgctgtcgaagagcaattgggaagggccccacgaggtgtcctcgatatttcttaccgcagccctgatggagtacccggtgtggtgatgaccgcaccaaaactggatgacggaaccccattcccaaccctgtactacttgacagatccacgcctgaccaccgaggcatcccgcctcgaggtcgcattggtaatgaagtggatgactgatcgcctttccaccgacgaagagcttcgtgccgactaccagcgcgcccacgagcacttcctggcaaagcgcaacgcaattgaagatctcggcacggatttttccggcggtggcatgcctgaccgagtgaagtgccttcacgtcctcattgactatgcactggcagaaggcccacaccatttcctt

SEQ ID NO: 500 - protein, 139 aa, Corynebacterium glutamicum
MSVNEADLNAVEEQLGRAPRGVLDISYRSPDGVPGVVMTAPKLDDGTPFPTLYYLTDPRLTTEASRLEVALVMKWMTDRLSTDEELRADYQRAHEHFLAKRNAIEDLGTDFSGGGMPDRVKCLHVLIDYALAEGPHHFL

SEQ ID NO: 501 - DNA, 849 bp, Corynebacterium glutamicum
  CDS (101)..(826): RXC00236
aatgcgagagttctaaaacgagccggtaacatcgacccccatgagttcaggggttagaaaagcaatgggatttggatgcggttcggttttggccgtcatcatggtgatctcatttgttggatgggcgctcagcttcatggatggaacggcacctattcgccaactccagcaaatccctgaagatgttccgccggcgcgtggtgtagaagttccgcaaattgatacagaggcagatggacgcacatccaaccatttgcgtttttgggcggaaccaattgctcaagatactggtgtgtccgctcaagcgattgcggcttatggaaacgcagagctcatcgcgagtactgcgtggcctggctgcaatctggggtggaataccttggcaggtatcggccaggtggaaacccgtcacggtacctacaacggcaaaatgttcgggggcagttccctggatgaaaatggagttgcaacccctccaatcatcggcgttccacttgatggttcaccggggtttgcggaaattcccgacactgatggtggggaattagatggcgatactgaatatgatcgcgcggtaggtcccatgcagttcattccggaaacgtggcgacttatgggattggatgcaaacggtgatggggtagcggaccccaaccaaattgatgacgcagcattgagtgccgcaaacctgttgtgttccaacgatcgtgacttgtccactcctgaaggatggaccgcagctgttcattcttacaacatgtctaatcagtatttgatggacgttcgagatgctgccgcgtcctacgctttacgacagccggcgatctaaaacttaacaagcgcaacccc

SEQ ID NO: 502 - protein, 242 aa, Corynebacterium glutamicum
MVISFVGWALSFMDGTAPIRQLQQIPEDVPPARGVEVPQIDTEADGRTSNHLRFWAEPIAQDTGVSAQAIAAYGNAELIASTAWPGCNLGWNTLAGIGQVETRHGTYNGKMFGGSSLDENGVATPPIIGVPLDGSPGFAEIPDTDGGELDGDTEYDRAVGPMQFIPETWRLMGLDANGDGVADPNQIDDAALSAANLLCSNDRDLSTPEGWTAAVHSYNMSNQYLMDVRDAAASYALRQPAI

SEQ ID NO: 503 - DNA, 1113 bp, Corynebacterium glutamicum
  CDS (101)..(1090): RXC00271
tagtttaaatcatgagacatttcacatatggttctttatccgagacatgtgttgacgctgtctgcccctttttgaaaataacactttaaggagatgtgccatgttttcttcccgttcgaaggtactcgcaagcatctttactgttggcgccttggcgttggcttcgtgctcaagcgattccagtgacagctccacctccactgatgctgcaggtggcgactcttaccgagttggcatcaaccagcttgttcagcaccctgcacttgatgcagcgaccactggtttcaaggaagcttttgaagaggcaggcgttgacgtcacctttgatgagcaaaacgctaacggcgagcagggcactgcactgactatttctcagcagttcgcttctgacaatttggatctcgtgttggctgttgcaactccagcagcacaggcaactgcgcagaatatcactgatatcccagtcctgttcaccgcagttaccgatgcagtgtcggcagagctggtggattctaatgaagcacctggcggaaacgtcaccggtacttctgatatcgcaccgattgagcagcagttggagcttttgcagcagctggttcctgacgcaaagtccatcggcatcgtctacgcgtctggtgaggtcaactctcaggtgcaggtcgatgaggtcaccaaggctgctgagccactggggctgtccgttaatactcagactgtcactaccgtgaacgagattcagcaggctgttgaagctctcggcgatgttgatgtcatctacgttccaactgacaacatggttgtttccggtatttcttctctggttcaggttgctgagcagaagcagatccctgtgatcggcgctgagtccggcactgttgagggtggcgcactggcaaccctgggtatcgattacaccgagcttggccgccagactggtgagatggctctgcgtattctgcaggacggcgaagacccagcaaccatgcctgtggagactgcaactgagttcacctacgtgatcaacgaagatgcagcagagcgccagggcgtggagatccctcaagagattttggataaggccgaacgcgtatgatcggcgcttttgagttcgga

SEQ ID NO: 504 - protein, 330 aa, Corynebacterium glutamicum
MFSSRSKVLASIFTVGALALASCSSDSSDSSTSTDAAGGDSYRVGINQLVQHPALDAATTGFKEAFEEAGVDVTFDEQNANGEQGTALTISQQFASDNLDLVLAVATPAAQATAQNITDIPVLFTAVTDAVSAELVDSNEAPGGNVTGTSDIAPIEQQLELLQQLVPDAKSIGIVYASGEVNSQVQVDEVTKAAEPLGLSVNTQTVTTVNEIQQAVEALGDVDVIYVPTDNMVVSGISSLVQVAEQKQIPVIGAESGTVEGGALATLGIDYTELGRQTGEMALRILQDGEDPATMPVETATEFTYVINEDAAERQGVEIPQEILDKAERV

SEQ ID NO: 505 - DNA, 1263 bp, Corynebacterium glutamicum
  CDS (101)..(1240): RXC00338
tcttagaaggcgtagtcacaccattaaccttgccagaatttttcaaggcttggctagacttgggaaacgaacatgcggtaccaaccaggggagttaatgcgtgagtgatgtaaccgttggcgatattcgccgcattttggatgaggcttatccgccggcgttggcggaaagctgggacaaagtggggctgatctgcggtgatccaacagagtcggtgaagcgtgtcggtttagcactcgattgcacccaggcagtggccgacaaggctgtggacatgggtttggacatgctgatcattcaccacccattgctgctgcgtggggtgacgtctgttgctgcggatgagccaaaaggcaaggtcattcacaccctaattcgcggcggggtggcactgttttccgcgcacactaatgcggattccgcgcgcccaggtgtcaacgataaactcgccgagctcgtcggcatcacggccgggcgacccatcgcgacacggcttttaggcggcatggacaaatggggcgtgcacgttctgcccaaggatgcagcgtacctaaagaagatgcttttcgacgcaggtgccggtgcgatcggcgactaccgagagtgtgcctttgagatcgaaggaaccgggcagtttaggcccgtggagggggcgaatccggcagagggggacgtcgataagctttttaaatcccttgagctgcgcatcgagtttgttgcaccgcgcaacctgcgcgcccggctcacgtcggtgctgcgggaggctcatccgtatgaggagcctgccttcgatattgttgaaatgcacagcgctgagagtttagaaaatgcgaccggattgggtcgtgtgggtgaattgccggagccgatgcgcctcgcggatttcgtgcaacaagtggccaacaacctgcctgtcaccgaatggggcgtgcgcgctaccggcgatcctgaacaaatggtgtcccgtgtggcggtttcatcagggtcgggtgacagtttcttaaacgatgtgattaagctcggagtggacgtttatgtcacttctgatctgcgccaccatccagttgatgaatatctccgagaaggtggccctgcagtaatcgatactgcacactgggccagcgaatttccatggacttcccaagcccaagaaattttgcaggacaaagccccacaggttgaagttgatgtgatttcgatccgcacagacccctggaccatgtctgcgcgagcagtgaactaaattcttgagaactaaaaaag

SEQ ID NO: 506 - protein, 380 aa, Corynebacterium glutamicum
VSDVTVGDIRRILDEAYPPALAESWDKVGLICGDPTESVKRVGLALDCTQAVADKAVDMGLDMLIIHHPLLLRGVTSVAADEPKGKVIHTLIRGGVALFSAHTNADSARPGVNDKLAELVGITAGRPIATRLLGGMDKWGVHVLPKDAAYLKKMLFDAGAGAIGDYRECAFEIEGTGQFRPVEGANPAEGDVDKLFKSLELRIEFVAPRNLRARLTSVLREAHPYEEPAFDIVEMHSAESLENATGLGRVGELPEPMRLADFVQQVANNLPVTEWGVRATGDPEQMVSRVAVSSGSGDSFLNDVIKLGVDVYVTSDLRHHPVDEYLREGGPAVIDTAHWASEFPWTSQAQEILQDKAPQVEVDVISIRTDPWTMSARAVN

SEQ ID NO: 507 - DNA, 1470 bp, Corynebacterium glutamicum
  CDS (101)..(1447): RXC00362
cactttttgggtgaaaattccacgaagttaatgccgctttaagtcaattcaatcacatgtaacatgctacggttttttcggtcacttaaaggaggcgcttatgggaatcattgctctgctcgtttttatcgcaattgccgtgatattgaatgtgtttttgaaacgagatatttcagaagcattgctagttggattagtaggaactgcgcttgtcggcggtgtaaatgcaccgacattactgattgatgctgtagtggatgctgctcagtcggaagttactttcgcaggtatggcctttgttttcatgggcatcgttgtgcaatcaactggattgattgatcgattaatcgcaatccttaactcgatttttggtcggcttcgaggtggcgcaggttatgtttccactcttggatctgcgctcattggactcatcgctggatcaacggctggaaactccgcgacggttggctcagtgacgatcccttggatgaaaaagacgggatggactgctgaaaggtccgcaacgttagtcgcgggcaactctggccttggtgttgcgttgcctcccaattcaacaatgttcatcattttggcattgccagctgcagcagcttcttcggcctctcaggtgtacattgctttggcttgtggtggtgcgtatgcagtgctctaccgcttagcggtcgtcttttactggacacgtaaagataaaattcctgccacccctgatgatcaacgggtgtcattcggtgaggcaatgaagactggatggcgttcaccgttgatcttccttggaattttgatccccgtaatcctcacaatcggcccattgtctgaatggttaaagacacatggagttggggagtctggtgttaaatcgatgtcgatcatcgtgtgggtgccaattctgattacggcaattgctctgattgaagggcgtaaacgaattgctaacaacatggcacactttagggttcagatctccaaggacttgccacaatttgccaccgtaggaatttcgttgttttctgcgcttgcagcagcgaacatcatggaagaactgggtgttggcccgcagttgtctaactggcttgattccatggacctacctaagtctgtcatggtgatcattgtctgcatcatgtgcattgtggtggcaacgccactgtcgtcaacagcaaccgcggctgcgattggtgctcccgctgtcgctgcgttggctgcggtaggtattgatccaactgtggcgatcgtagtgatcttgctgtgcacttccactgaaggtgcatccccgccggtgggcgcgccgatttacctttctgctgcgatcgccgatgcaaacccaacgaaaatgttcgtaccactgattacgtactttgttgtccccatgattctgcttgcttggctagttggaatgggattcttaccagtgattgttcctacgggttaaaggggtaaaaatgaactcaa

SEQ ID NO: 508 - protein, 449 aa, Corynebacterium glutamicum
MGIIALLVFIAIAVILNVFLKRDISEALLVGLVGTALVGGVNAPTLLIDAVVDAAQSEVTFAGMAFVFMGIVVQSTGLIDRLIAILNSIFGRLRGGAGYVSTLGSALIGLIAGSTAGNSATVGSVTIPWMKKTGWTAERSATLVAGNSGLGVALPPNSTMFIILALPAAAASSASQVYIALACGGAYAVLYRLAVVFYWTRKDKIPATPDDQRVSFGEAMKTGWRSPLIFLGILIPVILTIGPLSEWLKTHGVGESGVKSMSIIVWVPILITAIALIEGRKRIANNMAHFRVQISKDLPQFATVGISLFSALAAANIMEELGVGPQLSNWLDSMDLPKSVMVIIVCIMCIVVATPLSSTATAAAIGAPAVAALAAVGIDPTVAIVVILLCTSTEGASPPVGAPIYLSAAIADANPTKMFVPLITYFVVPMILLAWLVGMGFLPVIVPTG

SEQ ID NO: 509 - DNA, 1203 bp, Corynebacterium glutamicum
  CDS (101)..(1180): RXC00412
cttttgacgaacaccacgtcgcgtacgcttcctcggggcgttaaactatttgtcttccagcttttgtcccccgacttttgtacgaatcgaggacaccgtcgtgtcacacaccgcgtccacaccgacgccagaggaatactccgcgcagcaacccagcacccagggcactcgcgttgagttccgcggcataaccaaagtctttagcaacaataaatctgctaaaaccaccgcgcttgataatgtcactctcaccgtagaacccggtgaggtaatcggcatcatcggttactctggcgccggcaagtccactcttgtccgcctcatcaatggccttgactcccccacgagcggttcgttgctgctcaacggcaccgacatcgtcggaatgcccgagtctaagctgcgtaaactgcgcagtaatatcggcatgattttccagcagttcaacctgttccagtcgcgtactgcggctggaaatgtggagtacccgctggaagttgccaagatggacaaggcagctcgtaaagctcgcgtgcaagaaatgctcgagttcgtcggcctgggcgacaaaggcaaaaactaccccgagcagctgtcgggcggccagaagcagcgcgtcggcattgcccgtgcactggccaccaatccaacgcttttgcttgccgacgaagccacctccgctttggacccagaaaccacccatgaagttctggagctgctgcgcaaggtaaaccgcgaactgggcatcaccatcgttgtgatcacccacgaaatggaagttgtgcgttccatcgcagacaaggttgctgtgatggaatccggcaaagttgtggaatacggcagcgtctacgaggtgttctccaatccacaaacacaggttgctcaaaagttcgtggccaccgcgctgcgtaacaccccagaccaagtggaatcggaagatctgcttagccatgagggacgtctgttcaccattgatctgactgaaacgtccggcttctttgcagcaaccgctcgtgctgccgaacaaggtgcttttgtcaacatcgttcacggtggcgtgaccaccttgcaacgccaatcatttggcaaaatgactgttcgactcaccggcaacaccgctgcgattgaagagttctatcaaaccttgaccaagaccacgaccatcaaggagatcacccgatgaacgagatgatcctcgcagct

SEQ ID NO: 510 - protein, 360 aa, Corynebacterium glutamicum
VSHTASTPTPEEYSAQQPSTQGTRVEFRGITKVFSNNKSAKTTALDNVTLTVEPGEVIGIIGYSGAGKSTLVRLINGLDSPTSGSLLLNGTDIVGMPESKLRKLRSNIGMIFQQFNLFQSRTAAGNVEYPLEVAKMDKAARKARVQEMLEFVGLGDKGKNYPEQLSGGQKQRVGIARALATNPTLLLADEATSALDPETTHEVLELLRKVNRELGITIVVITHEMEVVRSIADKVAVMESGKVVEYGSVYEVFSNPQTQVAQKFVATALRNTPDQVESEDLLSHEGRLFTIDLTETSGFFAATARAAEQGAFVNIVHGGVTTLQRQSFGKMTVRLTGNTAAIEEFYQTLTKTTTIKEITR

SEQ ID NO: 511 - DNA, 813 bp, Corynebacterium glutamicum
  CDS (101)..(790): RXC00526
ggtggagcaggcggcggctccttttagtcctgcggccccttttgaccctgcagcccctgccgtttctgccaagcaaaccgtgggccaggtgatttagcctatgagcctcatcgaaatgcgaaatattgtcaagacctacaacattggatctgaaggtgaactcaccgtgttgcacggtgtggatttccatgtggaccgtggcgaattcgtgtcggttgtgggtacgtccggctcaggtaaatcaacgatgatgaacatcattgggttgttggataagccaactgatggcacgtacaccttggatggcgtggatgtgttggatatcagcgatgatgctttggcgagccaccgcgctaaatcgattggttttgtgtttcagaacttcaatctgattggccggatcgatgcgttgaagaatgtggaaatgcccatgatgtatgcgggcattccggctaagcagcggagaagtcgtgcggttgaattattggaaatggtcgggatgggtgagcgtctcaaccatgagcccaatgagctttcgggtggtcagaagcagcgcgtggccattgctcgcgcgttggcgaacgatcctgagatcattcttgctgatgaaccaactggtgcgttggattctgcaacgggccggatggtgatggatattttccaccagctcaacaaggagcagggcaaaaccatcgtgtttattactcacaaccctgagcttgctgatgaatctgatcgggtggtcaccatggttgacgggcgcatcattgggtctgaggtgaaacactcatgagccttgcagaatcaattctt

SEQ ID NO: 512 - protein, 230 aa, Corynebacterium glutamicum
MSLIEMRNIVKTYNIGSEGELTVLHGVDFHVDRGEFVSVVGTSGSGKSTMMNIIGLLDKPTDGTYTLDGVDVLDISDDALASHRAKSIGFVFQNFNLIGRIDALKNVEMPMMYAGIPAKQRRSRAVELLEMVGMGERLNHEPNELSGGQKQRVAIARALANDPEIILADEPTGALDSATGRMVMDIFHQLNKEQGKTIVFITHNPELADESDRVVTMVDGRIIGSEVKHS

SEQ ID NO: 513 - DNA, 1185 bp, Corynebacterium glutamicum
  CDS (101)..(1162): RXC01004
ccggacgctggatcgcacgagtaacggtcatggaagatcgacgcatcgacaaagccgttctcacccccatcacccatgaagaagcaaaggagtacgaaaagtgagtatttgggcaactgtccttctaattatcgtccttctttccgccaacgccttcttcgtggccgcggagttcgcactgatttcctcgcgccgggaccgcctggattccctggtatcccagggtaaaaagggagctgaaaaggttctctacgcaaccgagcacctctccatcatgttggcgggcgctcagttcggtattacggtctgttctctgattctgggtaaagtcgcagaacctgcgatcgcccacttcattgaggtgcctttcacctcctggggtgttccaaatgatttgatccacccaatttccttcgtcatcgcactggcgatcatcacctggttgcacattctctttggtgaaatggtgccaaagaacatcgctattgctggccctgaaaccttaggcatgtggcttgctccagtgctcattgcgtttgtgaagattacccgcccgttgatcgagttcatgaactggatcgcccgtctgacccttcgcgcctttggtgtggagcaaaaaaacgagctggattccaccgtggacccagagcagctggcatcaatgatttccgagtcccgttccgaaggcctccttgatgctgaagagcacgcccgcctgtccaaggcgctgcgctctgagcagcgttccatcaaggaactggtgattaaggatgaggacgtgcgcacgctggcgttcggtaaatctggcccgaccttgcaccagttggaggaagcagtccgcgagaccggtttctcccgcttccctgtcaccggccgcgatggatcctacttgggttatatccacatcaaggatattttgcctcgtctggctgatcctgagatggatccctccgagaccattccgcgttctgcactgcgccctttgagcaatgtggatgccgacggcctcatggatgacgtcttggattttatgcactaccgctccgcgcacatggctcaggttcgcctcaaaggtgagcttctcggcgtgattacgctggaggatctcatcgaagaatacgtgggcaccgtcaacgattggactcacgaaagctccgacgactagaaatagtaactgtgttggac

SEQ ID NO: 514 - protein, 354 aa, Corynebacterium glutamicum
VSIWATVLLIIVLLSANAFFVAAEFALISSRRDRLDSLVSQGKKGAEKVLYATEHLSIMLAGAQFGITVCSLILGKVAEPAIAHFIEVPFTSWGVPNDLIHPISFVIALAIITWLHILFGEMVPKNIAIAGPETLGMWLAPVLIAFVKITRPLIEFMNWIARLTLRAFGVEQKNELDSTVDPEQLASMISESRSEGLLDAEEHARLSKALRSEQRSIKELVIKDEDVRTLAFGKSGPTLHQLEEAVRETGFSRFPVTGRDGSYLGYIHIKDILPRLADPEMDPSETIPRSALRPLSNVDADGLMDDVLDFMHYRSAHMAQVRLKGELLGVITLEDLIEEYVGTVNDWTHESSDD

SEQ ID NO: 515 - DNA, 732 bp, Corynebacterium glutamicum
  CDS (101)..(709): RXC01017
gaaatttgagggggcgctacccttagaaggtgcgcaatgacaccacgatagttcgcgcctagtgtggattgctagaaaactttaagaaagaggaaataatatggctcaaaaagtaaccttctggttcgataccacctgcccattctgctgggtcacctcccgctggattaaggaagtcgaacaagtccgcgatattgaaatccagtgggttccaatgagcctcgctgtcctaaacgaaggccgtgatctcccagaggattacaaggagcgcatgaaggctgcatggggaccagcacgcgttttcgcagctgtcgccaccgaccatgctgacaagctcggcgacctgtacaccgcaatgggtacccgcatccacaacgacggtcgcggaccaatcgaaggttccttcaatgatgtcatcgcagaggcacttgaagaggtcggcctagacgctgcacttggtgaagttgcagacaccaccgaatgggacgacgcacttcgcgcattccaccagaccgcaatggacgaggtcggcaacgatgtcggaaccccagtggtcaagctcggcgacaccgctttcttcggcccagtgctcacccgcatcccacgcggcgaggaagcaggagagatcttcgacgcttccttcaagctcgcaagctatccccacttctttgaaatcaagcgcagccgcactgagaacccacagttcgactaattaacgctgtctctgcttat

SEQ ID NO: 516 - protein, 203 aa, Corynebacterium glutamicum
MAQKVTFWFDTTCPFCWVTSRWIKEVEQVRDIEIQWVPMSLAVLNEGRDLPEDYKERMKAAWGPARVFAAVATDHADKLGDLYTAMGTRIHNDGRGPIEGSFNDVIAEALEEVGLDAALGEVADTTEWDDALRAFHQTAMDEVGNDVGTPVVKLGDTAFFGPVLTRIPRGEEAGEIFDASFKLASYPHFFEIKRSRTENPQFD

SEQ ID NO: 517 - DNA, 622 bp, Corynebacterium glutamicum
  CDS (101)..(622): RXC01021
cgagaggcttttttggctctaagccttttagtcgtgcgaacgaaatcttaagcagcctcggtgccaccgagatcgattggtcgctgtaaggtatctgattatgtccagttccgaaagctcgcgttccgaaggctcgcagccagcaccgtctgtacagcctgaacgccgtgctgattcaacgggggctcctgcggcagcttccaaggaagcttcccaacaaatggacgctgccggagttcttgagtgggccaggaccgctgtcgagcagctttctgaacgtcgtgcagagatcaatgcactgaatgtctttcctgttccagatgcagacactggatcaaacatgacctacaccatgacagctgcgttggatgaagcgctgaaactgggggagttgggtgatgtcgcaaggattactgaggctttggctgttggttctgtgcgtggagcccgaggaaattctggagtagtccttagtcaggtccttcgcgctattgctcaggcagctgctgacggggttattgatggccacacaatccaagaagcgctatccattgctcgctccctagttgatcgcgcaattacagatcctgtggagggcactgttgtcactgtgttgcgttct

SEQ ID NO: 518 - protein, 174 aa, Corynebacterium glutamicum
MSSSESSRSEGSQPAPSVQPERRADSTGAPAAASKEASQQMDAAGVLEWARTAVEQLSERRAEINALNVFPVPDADTGSNMTYTMTAALDEALKLGELGDVARITEALAVGSVRGARGNSGVVLSQVLRAIAQAAADGVIDGHTIQEALSIARSLVDRAITDPVEGTVVTVLRS

SEQ ID NO: 519 - DNA, 1047 bp, Corynebacterium glutamicum
  CDS (101)..(1024): RXC01212
tttagaagccacatgacatatgtcatgaaaattatgtgcaaagtgcagtaatactcctgacatatggctctaccagcgccaatgcgaagtaggaagaattatgcctatgacaacgacaccagcaatcgacgtaacagacctcgtgagaacctacggcgactacaccgcagtcaagggcctgaatttccatgtacagcgcggtgaagtatttggtctgctcggcaccaacggggccggcaaaacctccaccttggaagtcatcgaaggactttccgcacccagctccggcaccgtgcgcatctccgggcttgaccccgttgccgaccgcgcgatcctgcgccccgagctcggcatcatgctgcaatcaggcggcctgccatcacagctcaccgtcgccgaaaccatggacatgtggcacggcacctgcacgtatccgcgcgccattaaagatgtgcttgccgacgtcgacctcctacaccgcgaaaacgtcaaggtcggcgcgctttccggaggcgaacaacgacgccttgatttggcctgcgcactgcttggcgacccctcaattttgttcctcgacgaacccaccaccggcctcgacccagaatctaggcgccacacctggcaactcctgctggacctgaaacagcgcggcgtcaccatgatgctgaccacccactacctggaggaagccgaattcctctgcgaccggattgccatcatgaacgccggtgagatcgcagtggaaggcaccttggatgaactggtggcccgcgagaagtcgatcatcagtttcgtgctgcgtggcgggcaggtggagttgccggtcttgagtggggctgaaatcatccgcgacaacaaccacgtccgcatcgccaccaccaccctgcagcagcacaccttagaaatacttacctgggctgcagagaccgggatcgcgctggaaggcttcgctgcaaaacccgccaccttggaatccgtattcatggacatcgcctcactcgagaacacctcgctgcaaaccgcctagaatctttaaggagaccacaa

SEQ ID NO: 520 - protein, 308 aa, Corynebacterium glutamicum
MPMTTTPAIDVTDLVRTYGDYTAVKGLNFHVQRGEVFGLLGTNGAGKTSTLEVIEGLSAPSSGTVRISGLDPVADRAILRPELGIMLQSGGLPSQLTVAETMDMWHGTCTYPRAIKDVLADVDLLHRENVKVGALSGGEQRRLDLACALLGDPSILFLDEPTTGLDPESRRHTWQLLLDLKQRGVTMMLTTHYLEEAEFLCDRIAIMNAGEIAVEGTLDELVAREKSIISFVLRGGQVELPVLSGAEIIRDNNHVRIATTTLQQHTLEILTWAAETGIALEGFAAKPATLESVFMDIASLENTSLQTA

SEQ ID NO: 521 - DNA, 1131 bp, Corynebacterium glutamicum
  CDS (101)..(1108): RXC01306
tgttttagaggtagagcgaaacgtgcctgtaaaactggcgctcgctgtgctcgaagaccacccagacaatcaccccgctccgaaggagaatcgctaagccatgactgaatggtatgtcgttttacccgccactattctactcatcgcgctgtctgcgtttttcgtcatcattgagttcgctttgcttgcagctaggcggaaccggttagaggagactgtggaaacctcgcggtcttcccgcgctgcgttgcgaagcctcaatgaacttactctcatgctcgcgggcgcgcagttgggaatcaccatggtgactttcgcgttgggtgctatcacgaagccgtgggttcattatgctttgatgccgctcttcgaatgggcgcgtataccgctggttatggcagatgtcattgcgtttattttgtcgctgtttatcgtaacgtttctgcacttggtcatcggcgaaatggctccgaaatcctgggcaatcgcgcatccggagacggcacttcgaactatcgcgattcccgcacggggcttcattaacctgtttcgtccattgctgcagtggatcaacaaaatggcgaacgatttggtccgcaaagttggtgaaactcccgttgatcgagctgcagctggtggctatgacaccgataccctccatgccctcattgagcattcccgagaaactggcgctctggatcagcaatccgccgcccaaatcagcggaattatcaagctggataaaatcacggtcggtcaaaccctgaccgcatctccatttacgcacagcgccagcgccacggttgctgaggtgcaagccgcagctcagcgcagtggcagcttgcgtgtgcttatcgacgccccctcccaccttttcccacacgtcattcatgtgcgagacacccttggtgcctcgccagacgagaaggcttcgaagtggtctcgcccaatcctcaccgttgctgagaccgacacgttacaccaagcgctggaatacatgcgggagcataacgagcagatcagtgcggtgctttccgctgatgggaaaacggtgcttggtgtaataacttgggatcacatcttgaaatacctgtggcctgcatcggtgtagctaatttgaggtgcgctgaa

SEQ ID NO: 522 - protein, 336 aa, Corynebacterium glutamicum
MTEWYVVLPATILLIALSAFFVIIEFALLAARRNRLEETVETSRSSRAALRSLNELTLMLAGAQLGITMVTFALGAITKPWVHYALMPLFEWARIPLVMADVIAFILSLFIVTFLHLVIGEMAPKSWAIAHPETALRTIAIPARGFINLFRPLLQWINKMANDLVRKVGETPVDRAAAGGYDTDTLHALIEHSRETGALDQQSAAQISGIIKLDKITVGQTLTASPFTHSASATVAEVQAAAQRSGSLRVLIDAPSHLFPHVIHVRDTLGASPDEKASKWSRPILTVAETDTLHQALEYMREHNEQISAVLSADGKTVLGVITWDHILKYLWPASV

SEQ ID NO: 523 - DNA, 513 bp, Corynebacterium glutamicum
  CDS (101)..(490): RXC01366
atgcatgaaaacaaattctatgtgtgttgagctgccaaaaggggttggcgcgccgatgatgactgtccaaacctaaaccaaaggtctaaactttggcttcgtgagtcagtttcgtcgttgttcccgccctggttgtggcaagcctgccgtcgcaaccctcacctacgcatattcggattccactgcggtggttggtcctttggcgcctgcagcagagccccatagttgggatctgtgtgagcatcatgccgagcgtattactgcgccccttggttgggagatgctgcgggtgaacgacatcaaagtcgatgacgatgaggatctgacggctcttgctcaggctgttcgtgaggctggacgcactgtgagtggtctggttcctgaagacgaagtgggcggcaaccatccggtgaaccggagtgcgcggatcgcggaacagaaggttcaccgcaggggtcatctctatgttgtgcctgatcaggacgaatcataaggtttgctattcggattgga

SEQ ID NO: 524 - protein, 130 aa, Corynebacterium glutamicum
VSQFRRCSRPGCGKPAVATLTYAYSDSTAVVGPLAPAAEPHSWDLCEHHAERITAPLGWEMLRVNDIKVDDDEDLTALAQAVREAGRTVSGLVPEDEVGGNHPVNRSARIAEQKVHRRGHLYVVPDQDES

SEQ ID NO: 525 - DNA, 614 bp, Corynebacterium glutamicum
  CDS (1)..(591): RXC01372
caggacaccttcgtccttcccaccttgcccacggccgcaggcttgtcgcctgcccgcatcgtggcgtcgataagcactcttttagatcttttagaagcagaccccagcattatttccgaccgcttggaacacctcgccgactgcattgatgaggaagtggaatcgctatcgccggaacgtgacgaactagtcaatcccggccgaaaactgcgcgcatacgtagatcacgcacggatcgtgcataccggccgaactgatgtgggactcgcgattgccaacgttatcgccccaatctggacccgacgaggcctggtatcagccgtgctggattttcccgagctcatggaatcattgccggaactccgcggacccgagccaattaccgacgatatattccatgacccattcatagatgacgaacccggggtggtaccgtttagggctgttgtctgggccgaagaggaacccggaatccccgatgccatggcgcaaagctgcgacggacctagcaaaggggcgctgacacaagcactgcgtttgctggtgcgcggacagtcagccacgacctattccattgaagaaaaggacttgtaaatggagctattggaaggctc

SEQ ID NO: 526 - protein, 197 aa, Corynebacterium glutamicum
QDTFVLPTLPTAAGLSPARIVASISTLLDLLEADPSIISDRLEHLADCIDEEVESLSPERDELVNPGRKLRAYVDHARIVHTGRTDVGLAIANVIAPIWTRRGLVSAVLDFPELMESLPELRGPEPITDDIFHDPFIDDEPGVVPFRAVVWAEEEPGIPDAMAQSCDGPSKGALTQALRLLVRGQSATTYSIEEKDL

SEQ ID NO: 527 - DNA, 669 bp, Corynebacterium glutamicum
  CDS (101)..(646): RXC01659
ttgatgcgcgccgcggtgagcagcctgccgatccagagcgtgaagaatctgatgatttagtcgagattgataccgtctctggattccgcctgctcagtacgtggcgggggttgcgcagcgttttgtcgacgagcgcattcacgtcggtttggattccatgccagaagctgtgactgctgtgtggatggaatctgattgggtgttggcggaaaccatcaagggttccacgccttccgattgggaagagattttgcggccgttggcgctgctcacggacgcgtctttcacgttgccacctcgttccacgcgtgcgcaaaccttggatttgaagcatttggaaccaagccgtctgaagccggagcagccagaaaagccagcgtttactcccaatgcttcggaagaagatttgtctcagccgttggtgatccgccccgaggagccgttgcagatgccggttcgcggtgtgcaggaaagccgcggagtggtcgagccacggtcattgggtgcggatgatgtggagtcgattgcggagggcgatccagagcgtccgagcgatctttatggcacgcgtgtgctgcgtgatctcaatggtcagtccagtattttccaagattccaccgacgcggatgagccaccaaaaaagtggtagaaaactggtgtttttcggcc

SEQ ID NO: 528 - protein, 182 aa, Corynebacterium glutamicum
VAGVAQRFVDERIHVGLDSMPEAVTAVWMESDWVLAETIKGSTPSDWEEILRPLALLTDASFTLPPRSTRAQTLDLKHLEPSRLKPEQPEKPAFTPNASEEDLSQPLVIRPEEPLQMPVRGVQESRGVVEPRSLGADDVESIAEGDPERPSDLYGTRVLRDLNGQSSIFQDSTDADEPPKKW

SEQ ID NO: 529 - DNA, 981 bp, Corynebacterium glutamicum
  CDS (101)..(958): RXC01663
tattttgctggttggtcacagtggagcgctaaccccgagaatcctatcgaggcctaaaatcgtggcttgagtacgcactgccagtaaggtgtgtgatgtgatggaaataagtgtcttgatcatcgccgcactgatcttggtggcaggcatcgtactgtggcgcgcggactcgtctaaacaggcagctaaaaaggctgaatcacctgtgggctcagtcgcacctgcgcccgtgctggttgaagaagagccggaccctgagtttgagccagaactggaccctgaaccagaagcgcaaccagaaccagagctggaagttgcgcctagatttgcgccagaaccagttcaagatcttgagccggatcaggctgaggacatttattttgatgattcccctgaactcgatgctgatgttgaaaatgccttggctgagcttactgaggtagaagactacccggaagagccagtgcagtctgagcaacctcaagcccctgccacggcggaggtagctgcggacgaggagcaacggggcgtcgataagcattcgtttttgagctctttgcctggttcgcagcgccgggagcgccgaaactgggcggcgaagcaccacttcgatttcatcaaggaagatgcctttttgaccgatgaatggtcaaggggtgcggcatcgactggtgccgttgcacgtgatgtggtcagtggcatggctgaaggatatgaaacgcatctggtggatttggcgggcgtgcccgtgatggcgatgcgccgtggaattacctctgacgtggtcattgatgcgcgccgcggtgagcagcctgccgatccagagcgtgaagaatctgatgatttagtcgagattgataccgtctctggattccgcctgctcagtacgtggcgggggttgcgcagcgttttgtcgacgagcgcattcacgtcggtttggattccatgccagaagctgtgactgctgtgtggatggaatct

SEQ ID NO: 530 - protein, 286 aa, Corynebacterium glutamicum
MEISVLIIAALILVAGIVLWRADSSKQAAKKAESPVGSVAPAPVLVEEEPDPEFEPELDPEPEAQPEPELEVAPRFAPEPVQDLEPDQAEDIYFDDSPELDADVENALAELTEVEDYPEEPVQSEQPQAPATAEVAADEEQRGVDKHSFLSSLPGSQRRERRNWAAKHHFDFIKEDAFLTDEWSRGAASTGAVARDVVSGMAEGYETHLVDLAGVPVMAMRRGITSDVVIDARRGEQPADPEREESDDLVEIDTVSGFRLLSTWRGLRSVLSTSAFTSVWIPCQKL

SEQ ID NO: 531 - DNA, 1545 bp, Corynebacterium glutamicum
  CDS (101)..(1522): RXC01693
aggagactggctggattattggctggttttcttgggaaatcgtcatgggcattaatcctagtcccaacaattgccagaacccgaacactaggcttgaaccatgaatactgcacctttcaaactcgaagctgacttcgcatcagccctgcccaccatggcagccccctggcaaggtgaggaagcccccaaccctgagctcgtgattttaaatgacgacctcgcctacagcctcgggcttgatccgacatggcttcgcacacctgagggcgttcaatttcttctcggactcaaccccgagcccttaacaaaagcagttgcgcaggcctattccggccaccaattcggacagtttgtggcaagccttggtgatggccgagcgcttcttctcggcgaagcccgctcagctgacggcgtactgcatgatatccacctcaaaggatctggacgaacccaattctcccgaggagccgatggacgcgccgtccttggccccgtcttacgcgaatacatcatctccgaagcgatgcatgcacttggtgttcccaccaccaggtcacttgcagtaattagcaccggtaggaaaatccaacgaggaagcgtagccccaggcgcagtccttgttcgagtagcaaccagcctcattcgagtcggatccttccaatactccaacatctctggtggcatcgaactatctcaacacctggcgaactatacgatcaccaggcatttcccttcgttggtagctgaactatccgcaccaacccccgcaacttatgtatcactgtttaaagcgattcttcagcgccaagcagacaccgttggaaaatggaccaggctgggtttcgttcacggagccctcaacacagacaacacgttgatatccggagaaactgttgactacggcccatgcgctttcatggagcgctaccgtggcgacgcgaaatttagctccatcgacacttatggtcgctacaaatttgaaaaccaacctatgatcctcggatggaacatggcccgcctcgtagaaaccctcctcccactcctgggcgccacaccagacgaaggcatgacagcagcccaagaagctctcgtagaattcgatgacctctgcgaacaagcaatccgaaaagaattcgccactgcactgggccttgacgagtcagacaccggcacggtagagcagttccgtgaactgctctacctccataaccccgacatcaccacgctgctgcgcgcactcaccgacaacaccgcaccaccgagtggctttgaagcattcgttcacgactggaaaacccaagacccagatatcgaagcaatgcgagcagtaaatccacttttcattccacgcaatcacctcgtggaagctgctctcgcagacgcagttgaagggaatctagaaaagttccacgaactcctcgctgctgtcaccaatccttttgatccaactgcgggccccgatgaactacgcctgccaagcgaagaaggatttgaagaagactacatgaccttctgcggtacctaggacagatggtggggcagacg

SEQ ID NO: 532 - protein, 474 aa, Corynebacterium glutamicum
MNTAPFKLEADFASALPTMAAPWQGEEAPNPELVILNDDLAYSLGLDPTWLRTPEGVQFLLGLNPEPLTKAVAQAYSGHQFGQFVASLGDGRALLLGEARSADGVLHDIHLKGSGRTQFSRGADGRAVLGPVLREYIISEAMHALGVPTTRSLAVISTGRKIQRGSVAPGAVLVRVATSLIRVGSFQYSNISGGIELSQHLANYTITRHFPSLVAELSAPTPATYVSLFKAILQRQADTVGKWTRLGFVHGALNTDNTLISGETVDYGPCAFMERYRGDAKFSSIDTYGRYKFENQPMILGWNMARLVETLLPLLGATPDEGMTAAQEALVEFDDLCEQAIRKEFATALGLDESDTGTVEQFRELLYLHNPDITTLLRALTDNTAPPSGFEAFVHDWKTQDPDIEAMRAVNPLFIPRNHLVEAALADAVEGNLEKFHELLAAVTNPFDPTAGPDELRLPSEEGFEEDYMTFCGT

SEQ ID NO: 533 - DNA, 1236 bp, Corynebacterium glutamicum
  CDS (101)..(1213): RXC01703
gttagacaaatgggtaaacagagctgacctagcggaatccgccatcaacgaaaggcattccgcgagggtttggggtctgcctcgaacaaatcttgggtttgtggcatggccatccaacgccaaagaaaaactgtttatccactggcactactggtggcaagcgcattatctagactgcctggtggatgctgctcgtcgacgcaccacaaaggcccgtcgcgaccgcatcagggacaccatccgcggcatttcggtgcgcaatgtgggcaagctgacctcgaatcgttattacgacgacaaagcttggctggcccttgctcttgggcgtgccggaaaagtgcgaaaggtgcgcacaccaaaatcattgccctcgttggaacaaaacatcgtcgatggcattgattcccttactggtgtgctgccgtggcgttccggcgaaaccttctacaacgttccctccaacggtcctgctgcgatcatgatggcccgcaccgaccgtttggacgaggctatgaaaatcaccgattggatttttgacaacctgatcgatggcgacggccttgtgatggacggattgcgcatgcgcatgcacggacctgagcttgtccgttccatccacccgtattgccaaggtgtcgccattggtgcgtgtttggaaattgctctcaaactgcgtgagcgcgcaggcttgaccactactgtggtggatcactggtcggatgccgataaggcagaagactccctcaaatactttgcacacatccacgctgtggttcaggctgtgtcgcggaagatgaccaacttccacggcgttattgattgggacaccggtgacggcgacggcggtttgttcaagggcattttggtccgctatttagctgatgtggccatccgcctgcctgacgattcaccaaccaaccgggaaaccaaaaagattgcagcacgcctggtactggaatcggcggaaagcgtatggaaccaccgattggaagttgatggccttccggtattcgccacagactggacaacggatgcacgcctgccacaaaactttggtttgagttcctctagtttgagcgatctggtgagtgttgtgcgcgtggatgaacgtgatctgtccgtgcaattgtccggttggatgctcatggaagcagcagcgaaagtggccgaagaactggaaaacaacggcaatagttacaccggtcgctcccgatagccccgatagtgtatgtgctg

SEQ ID NO: 534 - protein, 371 aa, Corynebacterium glutamicum
VAWPSNAKEKLFIHWHYWWQAHYLDCLVDAARRRTTKARRDRIRDTIRGISVRNVGKLTSNRYYDDKAWLALALGRAGKVRKVRTPKSLPSLEQNIVDGIDSLTGVLPWRSGETFYNVPSNGPAAIMMARTDRLDEAMKITDWIFDNLIDGDGLVMDGLRMRMHGPELVRSIHPYCQGVAIGACLEIALKLRERAGLTTTVVDHWSDADKAEDSLKYFAHIHAVVQAVSRKMTNFHGVIDWDTGDGDGGLFKGILVRYLADVAIRLPDDSPTNRETKKIAARLVLESAESVWNHRLEVDGLPVFATDWTTDARLPQNFGLSSSSLSDLVSVVRVDERDLSVQLSGWMLMEAAAKVAEELENNGNSYTGRSR

SEQ ID NO: 535 - DNA, 800 bp, Corynebacterium glutamicum
  CDS (1)..(777): RXC02254
atcgccgttgccgaagaaggcggattgtgggaaaacctcctgcagcaccgcttcggtggacatggtgcgctagctggtcacgccttgggaaacctcgtgatcgcggcgttgaccgacattttgggcacctcccagcatgcgcttgatcaaatcgctcaactcgctggagccaaaggacgcatcatcccggtatgtgctgaacctttggatcttgaagcggaagtatcaggtctagactctgatgctcgagtcatgcgtcaagttcgtggtcaagtggcggtagctgcaacccccgggcaggtgcgacgcgttcgaatcattccggacaatccagaaccgaaccccgctgccatcgaggccattctcgatgcagatttggtcacccttggcccaggttcctggttctcctctgtgattccacacattttggtcccagggatcgttgatgccttggcgcagacaaaagcaaccaaaaccgtggtgttaaacctgacgtccgagccaggggagaccgcgggattctctgcagaacgacacatccatgtgctccgccagcatgctcgaaaccttcaggttgaccaagtcattgtcgatgccaagacactgtcctcacaaaccgaacgcaatcatgtagaacgagctgctcgcacccttggtgcagaagtctccttccatgatgtccaggctgaagatggccgtggtcgattcaccagtattcacgatccagcaaagctgtgtgcagcgttgctggcaagttttgctggagcacgaaagcgttaaggagtaggcgtgtcactgac

SEQ ID NO: 536 - protein, 259 aa, Corynebacterium glutamicum
IAVAEEGGLWENLLQHRFGGHGALAGHALGNLVIAALTDILGTSQHALDQIAQLAGAKGRIIPVCAEPLDLEAEVSGLDSDARVMRQVRGQVAVAATPGQVRRVRIIPDNPEPNPAAIEAILDADLVTLGPGSWFSSVIPHILVPGIVDALAQTKATKTVVLNLTSEPGETAGFSAERHIHVLRQHARNLQVDQVIVDAKTLSSQTERNHVERAARTLGAEVSFHDVQAEDGRGRFTSIHDPAKLCAALLASFAGARKR

SEQ ID NO: 537 - DNA, 1059 bp, Corynebacterium glutamicum
  CDS (101)..(1036): RXC02255
gtgtgcagcgttgctggcaagttttgctggagcacgaaagcgttaaggagtaggcgtgtcactgacgagtgatatcaaacaagaattggcgcaggtccatgtggccaaaaacagtgttcgtgctgcggaagtgtctgcaattttaaggtttgctggtgagatgcaagctgtcggcggcaagctggtcatcgaagcaaatttggacagcatgcaagtcggtatgaggcttcaggagtttatccaaggtttgtacaactctcgagtcgatgtgcacaccgtgaacccgactgtgagcaggaaaacgccacggtatttggtgcgcatcattgacaatgccgatgaaattgcgcgacgcaccggactggtcaccaggtctggacatgtggttaaaggtctagcgccttctgtggtcagcggaacaatcagtgacgctgaagctgcatggcgcggtgcgtttctagccaatggatctttaagtgatccaggtcgttcctcttcgttggaggtgttgtgtcctggtcaagaatcagcattggcactggttggatgtgcgcgaagaattgggatcgcggcgaaaacgaaagattctcgaggatttgatcgcgtcaatgttcgtgatgcggaagcaattggggcactgctcactcgaatgggtgcccagaaaactcgcatgttgtgggaagaaaaacgcatcaagcgggaaagtcgaactccgcaaaccgggttggccaacttcgacgatgccaatctgcgcaggtcagcccgagcagcagttgccgctgcagcgagggtagaacgcgccatgaagattcttggtgatgatgttcctgagcatttggctgaggctggacagctgcgtgtgcagcaccgtcaggcatcgttggaggagttgggccggttggctgatcctcaaatgaccaaggatgctgtggccggtcgtattcgtcgtcttttgacgatggcagataagcgcgccgaagatctgaagattcctgatacaaattctgttgtgacggaagatttgttggaagaaatttagatgattgaagcctaaaaacg

SEQ ID NO: 538 - protein, 312 aa, Corynebacterium glutamicum
VAKNSVRAAEVSAILRFAGEMQAVGGKLVIEANLDSMQVGMRLQEFIQGLYNSRVDVHTVNPTVSRKTPRYLVRIIDNADEIARRTGLVTRSGHVVKGLAPSVVSGTISDAEAAWRGAFLANGSLSDPGRSSSLEVLCPGQESALALVGCARRIGIAAKTKDSRGFDRVNVRDAEAIGALLTRMGAQKTRMLWEEKRIKRESRTPQTGLANFDDANLRRSARAAVAAAARVERAMKILGDDVPEHLAEAGQLRVQHRQASLEELGRLADPQMTKDAVAGRIRRLLTMADKRAEDLKIPDTNSVVTEDLLEEI

SEQ ID NO: 539 - DNA, 681 bp, Corynebacterium glutamicum
  CDS (101)..(658): RXC02435
tcatgaatgtagaacggatttatcgacaagcgccagcaagtacgttgatctctttagccatcatcgctgtgtacgcagtgcggccattcaatcgagatcagtgacagacaacctgggttcaaccagtatcggtgacgcgtggattctgtacgcaccgctgatggatgatggtggctttggtccactgcgtgccatcggaggaatgttcctgcacattggccccgggcacatgctgttgaaccttgtgttgttgtggttgctgggaagagaaattgaacgagacttcggttctgcgcttttcactgcgatgtactttgtgggcggtattggtgcgtctgcagctgtcatctggatggatccctattcaccgacagcaggtgcttccggcgccatttacgccatgatggctattttggtggggctttttgtgttaagaagcgcggatatccgagcacccttgatccttatcgccatcaacatcgcctataccttgatgtccaccaatgtttctctgtggggacaccttggaggtttgatcactggagctttaattacttggccaatggttaaagcgaaaactcaaagaacacggtggattatcgtgctcattggttttgctgtagttgtggctgctgtcattctaggaattgaccgggtgtagacacattccgcccattgccc

SEQ ID NO: 540 - protein, 186 aa, Corynebacterium glutamicum
VTDNLGSTSIGDAWILYAPLMDDGGFGPLRAIGGMFLHIGPGHMLLNLVLLWLLGREIERDFGSALFTAMYFVGGIGASAAVIWMDPYSPTAGASGAIYAMMAILVGLFVLRSADIRAPLILIAINIAYTLMSTNVSLWGHLGGLITGALITWPMVKAKTQRTRWIIVLIGFAVVVAAVILGIDRV

SEQ ID NO: 541 - DNA, 681 bp, Corynebacterium glutamicum; identical to SEQ ID NO: 539
  CDS (101)..(658): FRXA02435

SEQ ID NO: 542 - protein, 186 aa, Corynebacterium glutamicum; identical to SEQ ID NO: 540

SEQ ID NO: 543 - DNA, 1141 bp, Corynebacterium glutamicum
  CDS (101)..(1111): RXC03216
gctgtatcacagtcagctgcagcaggtggcgaaaccgttgcggtcccagcggctgctctgatccctgcaaacaactagaaactattcagaaagcatcaccatgaaactcggtctctacaacgcgatcttccacgaccgcaccctgccagaagcgctcgcagccatcaaagctgcaggtctcaccggaattgaactcaacaccggcggatttttgcctgcaacccacatcccgaccatcgatgacatcctggtcagcgatgatgcccgcgatgaattcctcgggattttcgaaggcaccggcgtcgacatctacggccttaactgcaacggcaacccgcttcaccccaacaaggcgatcggggacaagcatgccgaagacattcgacgttccatccgcctcgcagagcgcctcggccaaaaccgtgtggtcaccatgtctggtcttcctggtggcgaaccaggcgcgaagtacaccaactgggttgtcaacgcgtggaactccgcagccttggatgtccttgattaccaatgggatatcgcagctgaattctggcgcgagaccgaccgcttcgccgcagatcacggcgtgaaagtggctcttgagctgcacccacagaacatcgtgttcaactccgctgacgtgcataagctcatcgatctcaccggcgccacccacgtgggcgtcgaactggatgcatcacacctgttctggcagcagatggacccaatcgctgtgattgatcacctcggcgagctcatcttccacgccgccgccaaagacgtgcgagttaataaggaatgggctcagctcaacggtgtgctggacaacagcttccgacgccttgacccatccgaaaaccgcaccaacttgggcggcgacgagtgggcgaatgaatggccaaagaactctgcttgggatttcgttgctctgggccgcggtcatgacgttgcttactggaccgaattcctccgcgcacttcaccgcgtcgatccaaacatgctggtcaacatcgaacacgaggatgtttcactcggtcgcgaagaaggcgtcaacgaagccgctaaggtgctgatcgaggccaacaaggcactcgaagagtccctggtttcttaaaaaaactacgcctgccccgcaacgctt

SEQ ID NO: 544 - protein, 337 aa, Corynebacterium glutamicum
MKLGLYNAIFHDRTLPEALAAIKAAGLTGIELNTGGFLPATHIPTIDDILVSDDARDEFLGIFEGTGVDIYGLNCNGNPLHPNKAIGDKHAEDIRRSIRLAERLGQNRVVTMSGLPGGEPGAKYTNWVVNAWNSAALDVLDYQWDIAAEFWRETDRFAADHGVKVALELHPQNIVFNSADVHKLIDLTGATHVGVELDASHLFWQQMDPIAVIDHLGELIFHAAAKDVRVNKEWAQLNGVLDNSFRRLDPSENRTNLGGDEWANEWPKNSAWDFVALGRGHDVAYWTEFLRALHRVDPNMLVNIEHEDVSLGREEGVNEAAKVLIEANKALEESLVS

SEQ ID NO: 545 - DNA, 1416 bp, Corynebacterium glutamicum
  CDS (101)..(1393): RXA02175
tgacatgcgcttggcgcatcccagttggtaagaataaacgggactacttccgtaatccggaagagtttttttccgaacaaatatgtttgaaagggatatcgtggctactgataacaacaaggctgtcctgcactaccccggtggcgagttcgaaatggacatcatcgaggcttctgagggtaacaacggtgttgtcctgggcaagatgctgtctgagactggactgatcacttttgacccaggttatgtgagcactggctccaccgagtcgaagatcacctacatcgatggcgatgcgggaatcctgcgttaccgcggctatgacatcgctgatctggctgagaatgccaccttcaacgaggtttcttacctacttatcaacggtgagctaccaaccccagatgagcttcacaagtttaacgacgagattcgccaccacacccttctggacgaggacttcaagtcccagttcaacgtgttcccacgcgacgctcacccaatggcaaccttggcttcctcggttaacattttgtctacctactaccaggaccagctgaacccactcgatgaggcacagcttgataaggcaaccgttcgcctcatggcaaaggttccaatgctggctgcgtacgcacaccgcgcacgcaagggtgctccttacatgtacccagacaactccctcaatgcgcgtgagaacttcctgcgcatgatgttcggttacccaaccgagccatacgagatcgacccaatcatggtcaaggctctggacaagctgctcatcctgcacgctgaccacgagcagaactgctccacctccaccgttcgtatgatcggttccgcacaggccaacatgtttgtctccatcgctggtggcatcaacgctctgtccggcccactgcacggtggcgcaaaccaggctgttctggagatgctcgaagacatcaagagcaaccacggtggcgacgcaaccgagttcatgaacaaggtcaagaacaaggaagacggcgtccgcctcatgggcttcggacaccgcgtttacaagaactacgatccacgtgcagcaatcgtcaaggagaccgcacacgagatcctcgagcacctcggtggcgacgatcttctggatctggcaatcaagctggaagaaattgcactggctgatgattacttcatctcccgcaagctctacccgaacgtagacttctacaccggcctgatctaccgcgcaatgggcttcccaactgacttcttcaccgtattgttcgcaatcggtcgtctgccaggatggatcgctcactaccgcgagcagctcggtgcagcaggcaacaagatcaaccgcccacgccaggtctacaccggcaacgaatcccgcaagttggttcctcgcgaggagcgctaaatttagcggatgattctcgt

SEQ ID NO: 546 - protein, 431 aa, Corynebacterium glutamicum
VATDNNKAVLHYPGGEFEMDIIEASEGNNGVVLGKMLSETGLITFDPGYVSTGSTESKITYIDGDAGILRYRGYDIADLAENATFNEVSYLLINGELPTPDELHKFNDEIRHHTLLDEDFKSQFNVFPRDAHPMATLASSVNILSTYYQDQLNPLDEAQLDKATVRLMAKVPMLAAYAHRARKGAPYMYPDNSLNARENFLRMMFGYPTEPYEIDPIMVKALDKLLILHADHEQNCSTSTVRMIGSAQANMFVSIAGGINALSGPLHGGANQAVLEMLEDIKSNHGGDATEFMNKVKNKEDGVRLMGFGHRVYKNYDPRAAIVKETAHEILEHLGGDDLLDLAIKLEEIALADDYFISRKLYPNVDFYTGLIYRAMGFPTDFFTVLFAIGRLPGWIAHYREQLGAAGNKINRPRQVYTGNESRKLVPREER

SEQ ID NO: 547 - DNA, 942 bp, Corynebacterium glutamicum
  CDS (101)..(919): RXA02621
atgtacctgactggtgcgcgacacttcgctcactaaagtttttaaagatttcgcttgaaggcagaccataaggtctgccttttcgcgtattaatgagtacatgtctgaacttatttgtggaccagctattctcttcgcaccagctggacgtgctgagatcattccaaaagcagcatcgaaggccgatatggtcatcattgatttggaagatggggcaggggaggtagaccgtgaggtcgcctacaggaacattagagaatcggggttggatcctaaacgaaccattgtgagaaccgtagggccgagcgatccacactttttggctgacgtggagatggtgaagtccacggatttcacacttgttatggttcctaaacttcttggcagcgtgcctgaggaattagatggcctcaacattatcgccatgattgaaacccctcaggctgcaaccagcattcctcagattgctgcggaccctaaagtcgttggaatgttctggggcgcggaggatctcacacacctcttgggaggcactcattctaggttcttgggtgatgagtccaatgaaggctcctaccgagacaccatgaggcttacacgcgccctgatgcacctccacgcggcggcgaatgggaagttcaccattgatgccatccatgcggatttccacgatgaagagggcctctatttagaagcggtcgatgctgcgcggactggtttcgctggcaccgcatgcattcaccccaagcagatcgagattgttcggagagcctatcggccagaggctaaccagttggagtgggcgaagaaagtggtggaggaagcagaaaaccatccaggtgcgttcaaactggatggtcagatgattgatgctccgttgatttcgcaggcgcggatggttatttcgcgtcagcctgcttgattagttcaagcgttttttcg

SEQ ID NO: 548 - protein, 273 aa, Corynebacterium glutamicum
MSELICGPAILFAPAGRAEIIPKAASKADMVIIDLEDGAGEVDREVAYRNIRESGLDPKRTIVRTVGPSDPHFLADVEMVKSTDFTLVMVPKLLGSVPEELDGLNIIAMIETPQAATSIPQIAADPKVVGMFWGAEDLTHLLGGTHSRFLGDESNEGSYRDTMRLTRALMHLHAAANGKFTIDAIHADFHDEEGLYLEAVDAARTGFAGTACIHPKQIEIVRRAYRPEANQLEWAKKVVEEAENHPGAFKLDGQMIDAPLISQARMVISRQPA

SEQ ID NO: 549 - DNA, 2337 bp, Corynebacterium glutamicum
  CDS (101)..(2314): RXN00519
tttccatgcggggctgaaactgccaccataggcgccagcaattagtagaacactgtattctaggtagctgaacaaaagagcccatcaaccaaggagactcatggctaagatcatctggacccgcaccgacgaagcaccgctgctcgcgacctactcgctgaagccggtcgtcgaggcatttgctgctaccgcgggcattgaggtcgagacccgggacatttcactcgctggacgcatcctcgcccagttcccagagcgcctcaccgaagatcagaaggtaggcaacgcactcgcagaactcggcgagcttgctaagactcctgaagcaaacatcattaagcttccaaacatctccgcttctgttccacagctcaaggctgctattaaggaactgcaggaccagggctacgacatcccagaactgcctgataacgccaccaccgacgaggaaaaagacatcctcgcacgctacaacgctgttaagggttccgctgtgaacccagtgctgcgtgaaggcaactctgaccgccgcgcaccaatcgctgtcaagaactttgttaagaagttcccacaccgcatgggcgagtggtctgcagattccaagaccaacgttgcaaccatggatgcaaacgacttccgccacaacgagaagtccatcatcctcgacgctgctgatgaagttcagatcaagcacatcgcagctgacggcaccgagaccatcctcaaggacagcctcaagcttcttgaaggcgaagttctagacggaaccgttctgtccgcaaaggcactggacgcattccttctcgagcaggtcgctcgcgcaaaggcagaaggtatcctcttctccgcacacctgaaggccaccatgatgaaggtctccgacccaatcatcttcggccacgttgtgcgcgcttacttcgcagacgttttcgcacagtacggtgagcagctgctcgcagctggcctcaacggcgaaaacggcctcgctgcaatcctctccggcttggagtccctggacaacggcgaagaaatcaaggctgcattcgagaagggcttggaagacggcccagacctggccatggttaactccgctcgcggcatcaccaacctgcatgtcccttccgatgtcatcgtggacgcttccatgccagcaatgattcgtacctccggccacatgtggaacaaagacgaccaggagcaggacaccctggcaatcatcccagactcctcctacgctggcgtctaccagaccgttatcgaagactgccgcaagaacggcgcattcgatccaaccaccatgggtaccgtccctaacgttggtctgatggctcagaaggctgaagagtacggctcccatgacaagaccttccgcatcgaagcagacggtgtggttcaggttgtttcctccaacggcgacgttctcatcgagcacgacgttgaggcaaatgacatctggcgtgcatgccaggtcaaggatgccccaatccaggattgggtaaagcttgctgtcacccgctcccgtctctccggaatgcctgcagtgttctggttggatccagagcgcgcacacgaccgcaacctggcttccctcgttgagaagtacctggctgaccacgacaccgagggcctggacatccagatcctctcccctgttgaggcaacccagctctccatcgaccgcatccgccgtggcgaggacaccatctctgtcaccggtaacgttctgcgtgactacaacaccgacctcttcccaatcctggagctgggcacctctgcaaagatgctgtctgtcgttcctttgatggctggcggcggactgttcgagaccggtgctggtggatctgctcctaagcacgtccagcaggttcaggaagaaaaccacctgcgttgggattccctcggtgagttcctcgcactggctgagtccttccgccacgagctcaacaacaacggcaacaccaaggccggcgttctggctgacgctctggacaaggcaactgagaagctgctgaacgaagagaagtccccatcccgcaaggttggcgagatcgacaaccgtggctcccacttctggctgaccaagttctgggctgacgagctcgctgctcagaccgaggacgcagatctggctgctaccttcgcaccagtcgcagaagcactgaacacaggcgctgcagacatcgatgctgcactgctcgcagttcagggtggagcaactgaccttggtggctactactcccctaacgaggagaagctcaccaacatcatgcgcccagtcgcacagttcaacgagatcgttgacgcactgaagaagtaaagtctcttcacaaaaagcgc

SEQ ID NO: 550 - protein, 738 aa, Corynebacterium glutamicum
MAKIIWTRTDEAPLLATYSLKPVVEAFAATAGIEVETRDISLAGRILAQFPERLTEDQKVGNALAELGELAKTPEANIIKLPNISASVPQLKAAIKELQDQGYDIPELPDNATTDEEKDILARYNAVKGSAVNPVLREGNSDRRAPIAVKNFVKKFPHRMGEWSADSKTNVATMDANDFRHNEKSIILDAADEVQIKHIAADGTETILKDSLKLLEGEVLDGTVLSAKALDAFLLEQVARAKAEGILFSAHLKATMMKVSDPIIFGHVVRAYFADVFAQYGEQLLAAGLNGENGLAAILSGLESLDNGEEIKAAFEKGLEDGPDLAMVNSARGITNLHVPSDVIVDASMPAMIRTSGHMWNKDDQEQDTLAIIPDSSYAGVYQTVIEDCRKNGAFDPTTMGTVPNVGLMAQKAEEYGSHDKTFRIEADGVVQVVSSNGDVLIEHDVEANDIWRACQVKDAPIQDWVKLAVTRSRLSGMPAVFWLDPERAHDRNLASLVEKYLADHDTEGLDIQILSPVEATQLSIDRIRRGEDTISVTGNVLRDYNTDLFPILELGTSAKMLSVVPLMAGGGLFETGAGGSAPKHVQQVQEENHLRWDSLGEFLALAESFRHELNNNGNTKAGVLADALDKATEKLLNEEKSPSRKVGEIDNRGSHFWLTKFWADELAAQTEDADLAATFAPVAEALNTGAADIDAALLAVQGGATDLGGYYSPNEEKLTNIMRPVAQFNEIVDALKK

SEQ ID NO: 551 - DNA, 1059 bp, Corynebacterium glutamicum
  CDS (1)..(1059): FRXA00521
ctcgacgctgctgatgaagttcagatcaagcacatcgcagctgacggcaccgagaccatcctcaaggacagcctcaagcttcttgaaggcgaagttctagacggaaccgttctgtccgcaaaggcactggacgcattccttctcgagcaggtcgctcgcgcaaaggcagaaggtatcctcttctccgcacacctgaaggccaccatgatgaaggtctccgacccaatcatcttcggccacgttgtgcgcgcttacttcgcagacgttttcgcacagtacggtgagcagctgctcgcagctggcctcaacggcgaaaacggcctcgctgcaatcctctccggcttggagtccctggacaacggcgaagaaatcaaggctgcattcgagaagggcttggaagacggcccagacctggccatggttaactccgctcgcggcatcaccaacctgcatgtcccttccgatgtcatcgtggacgcttccatgccagcaatgattcgtacctccggccacatgtggaacaaagacgaccaggagcaggacaccctggcaatcatcccagactcctcctacgctggcgtctaccagaccgttatcgaagactgccgcaagaacggcgcattcgatccaaccaccatgggtaccgtccctaacgttggtctgatggctcagaaggctgaagagtacggctcccatgacaagaccttccgcatcgaagcagacggtgtggttcaggttgtttcctccaacggcgacgttctcatcgagcacgacgttgaggcaaatgacatctggcgtgcatgccaggtcaaggatgccccaatccaggattgggtaaagcttgctgtcacccgctcccgtctctccggaatgcctgcagtgttctggttggatccagagcgcgcacacgaccgcaacctggcttccctcgttgagaagtacctggctgaccacgacaccgagggcctggacatccagatcctctaccctgttgaggcaacccagctctccatcgaccgcatccgccgtggcgaggacaccatctctgtcaccggtaac

SEQ ID NO: 552 - protein, 353 aa, Corynebacterium glutamicum
LDAADEVQIKHIAADGTETILKDSLKLLEGEVLDGTVLSAKALDAFLLEQVARAKAEGILFSAHLKATMMKVSDPIIFGHVVRAYFADVFAQYGEQLLAAGLNGENGLAAILSGLESLDNGEEIKAAFEKGLEDGPDLAMVNSARGITNLHVPSDVIVDASMPAMIRTSGHMWNKDDQEQDTLAIIPDSSYAGVYQTVIEDCRKNGAFDPTTMGTVPNVGLMAQKAEEYGSHDKTFRIEADGVVQVVSSNGDVLIEHDVEANDIWRACQVKDAPIQDWVKLAVTRSRLSGMPAVFWLDPERAHDRNLASLVEKYLADHDTEGLDIQILYPVEATQLSIDRIRRGEDTISVTGN

SEQ ID NO: 553 - DNA, 1694 bp, Corynebacterium glutamicum
  CDS (1)..(1671): RXN02209
accgagtccaccgttgttccttccatcgctggccctaagcgcccacaggaccgcatccttctctccgaggcaaaggagcagttccgtaaggatctgccaacctacaccgacgacgctgtttccgtagacacctccatccctgcaacccgcatggttaacgaaggtggcggacagcctgaaggcggcgtcgaagctgacaactacaacgcttcctgggctggctccggcgagtccttggctactggcgcagaaggacgtccttccaagccagtcaccgttgcatccccacagggtggcgagtacaccatcgaccacggcatggttgcaattgcatccatcacctcttgcaccaacacctctaacccatccgtgatgatcggcgctggcctgatcgcacgtaaggcagcagaaaagggcctcaagtccaagccttgggttaagaccatctgtgcaccaggttcccaggttgtcgacggctactaccagcgcgcagacctctggaaggaccttgaggccatgggcttctacctctccggcttcggctgcaccacctgtattggtaactccggcccactgccagaggaaatctccgctgcgatcaacgagcacgacctgaccgcaaccgcagttttgtccggtaaccgtaacttcgagggacgtatctcccctgacgttaagatgaactacctggcatccccaatcatggtcattgcttacgcaatcgctggcaccatggacttcgacttcgagaacgaagctcttggacaggaccaggacggcaacgacgtcttcctgaaggacatctggccttccaccgaggaaatcgaagacaccatccagcaggcaatctcccgtgagctttacgaagctgactacgcagatgtcttcaagggtgacaagcagtggcaggaactcgatgttcctaccggtgacaccttcgagtgggacgagaactccacctacatccgcaaggcaccttacttcgacggcatgcctgtcgagccagtggcagtcaccgacatccagggcgcacgcgttctggctaagctcggcgactctgtcaccaccgaccacatctcccctgcttcctccattaagccaggtacccctgcagctcagtacttggatgagcacggtgtggaacgccacgactacaactccctgggttccaggcgtggtaaccacgaggtcatgatgcgcggcaccttcgccaacatccgcctccagaaccagctggttgacatcgcaggtggctacacccgcgacttcacccaggagggtgctccacaggcgttcatctacgacgcttccgtcaactacaaggctgctggcattccgctggtcgtcttgggcggcaaggagtacggcaccggttcttcccgtgactgggcagctaagggcactaacctgctcggaattcgcgcagttatcaccgagtccttcgagcgtattcaccgctccaacctcatcggtatgggcgttgtcccactgcagttccctgcaggcgaatcccacgagtccctgggccttgacggcaccgagaccttcgacatcaccggactgaccgcacttaacgagggcgagactcctaagactgtcaaggtcaccgcaaccaaggagaacggcgacgtcgtcgagttcgacgcaatttgtccgcatcgacaccccaggtgaggctgactactaccgccacg

SEQ ID NO: 554 - protein, 557 aa, Corynebacterium glutamicum
TESTVVPSIAGPKRPQDRILLSEAKEQFRKDLPTYTDDAVSVDTSIPATRMVNEGGGQPEGGVEADNYNASWAGSGESLATGAEGRPSKPVTVASPQGGEYTIDHGMVAIASITSCTNTSNPSVMIGAGLIARKAAEKGLKSKPWVKTICAPGSQVVDGYYQRADLWKDLEAMGFYLSGFGCTTCIGNSGPLPEEISAAINEHDLTATAVLSGNRNFEGRISPDVKMNYLASPIMVIAYAIAGTMDFDFENEALGQDQDGNDVFLKDIWPSTEEIEDTIQQAISRELYEADYADVFKGDKQWQELDVPTGDTFEWDENSTYIRKAPYFDGMPVEPVAVTDIQGARVLAKLGDSVTTDHISPASSIKPGTPAAQYLDEHGVERHDYNSLGSRRGNHEVMMRGTFANIRLQNQLVDIAGGYTRDFTQEGAPQAFIYDASVNYKAAGIPLVVLGGKEYGTGSSRDWAAKGTNLLGIRAVITESFERIHRSNLIGMGVVPLQFPAGESHESLGLDGTETFDITGLTALNEGETPKTVKVTATKENGDVVEFDAICPHRHPR

SEQ ID NO: 555 - DNA, 1682 bp, Corynebacterium glutamicum
  CDS (1)..(1659): FRXA02209
gttgttccttccatcgctggccctaagcgcccacaggaccgcatccttctctccgaggcaaaggagcagttccgtaaggatctgccaacctacaccgacgacgctgtttccgtagacacctccatccctgcaacccgcatggttaacgaaggtggcggacagcctgaaggcggcgtcgaagctgacaactacaacgcttcctgggctggctccggcgagtccttggctactggcgcagaaggacgtccttccaagccagtcaccgttgcatccccacagggtggcgagtacaccatcgaccacggcatggttgcaattgcatccatcacctcttgcaccaacacctctaacccatccgtgatgatcggcgctggcctgatcgcacgtaaggcagcagaaaagggcctcaagtccaagccttgggttaagaccatctgtgcaccaggttcccaggttgtcgacggctactaccagcgcgcagacctctggaaggaccttgaggccatgggcttctacctctccggcttcggctgcaccacctgtattggtaactccggcccactgccagaggaaatctccgctgcgatcaacgagcacgacctgaccgcaaccgcagttttgtccggtaaccgtaacttcgagggacgtatctcccctgacgttaagatgaactacctggcatccccaatcatggtcattgcttacgcaatcgctggcaccatggacttcgacttcgagaacgaagctcttggacaggaccaggacggcaacgacgtcttcctgaaggacatctggccttccaccgaggaaatcgaagacaccatccagcaggcaatctcccgtgagctttacgaagctgactacgcagatgtcttcaagggtgacaagcagtggcaggaactcgatgttcctaccggtgacaccttcgagtgggacgagaactccacctacatccgcaaggcaccttacttcgacggcatgcctgtcgagccagtggcagtcaccgacatccagggcgcacgcgttctggctaagctcggcgactctgtcaccaccgaccacatctcccctgcttcctccattaagccaggtacccctgcagctcagtacttggatgagcacggtgtggaacgccacgactacaactccctgggttccaggcgtggtaaccacgaggtcatgatgcgcggcaccttcgccaacatccgcctccagaaccagctggttgacatcgcaggtggctacacccgcgacttcacccaggagggtgctccacaggcgttcatctacgacgcttccgtcaactacaaggctgctggcattccgctggtcgtcttgggcggcaaggagtacggcaccggttcttcccgtgactgggcagctaagggcactaacctgctcggaattcgcgcagttatcaccgagtccttcgagcgtattcaccgctccaacctcatcggtatgggcgttgtcccactgcagttccctgcaggcgaatcccacgagtccctgggccttgacggcaccgagaccttcgacatcaccggactgaccgcacttaacgagggcgagactcctaagactgtcaaggtcaccgcaaccaaggagaacggcgacgtcgtcgagttcgacgcaatttgtccgcatcgacaccccaggtgaggctgactactaccgccacg

SEQ ID NO: 556 - protein, 553 aa, Corynebacterium glutamicum
VVPSIAGPKRPQDRILLSEAKEQFRKDLPTYTDDAVSVDTSIPATRMVNEGGGQPEGGVEADNYNASWAGSGESLATGAEGRPSKPVTVASPQGGEYTIDHGMVAIASITSCTNTSNPSVMIGAGLIARKAAEKGLKSKPWVKTICAPGSQVVDGYYQRADLWKDLEAMGFYLSGFGCTTCIGNSGPLPEEISAAINEHDLTATAVLSGNRNFEGRISPDVKMNYLASPIMVIAYAIAGTMDFDFENEALGQDQDGNDVFLKDIWPSTEEIEDTIQQAISRELYEADYADVFKGDKQWQELDVPTGDTFEWDENSTYIRKAPYFDGMPVEPVAVTDIQGARVLAKLGDSVTTDHISPASSIKPGTPAAQYLDEHGVERHDYNSLGSRRGNHEVMMRGTFANIRLQNQLVDIAGGYTRDFTQEGAPQAFIYDASVNYKAAGIPLVVLGGKEYGTGSSRDWAAKGTNLLGIRAVITESFERIHRSNLIGMGVVPLQFPAGESHESLGLDGTETFDITGLTALNEGETPKTVKVTATKENGDVVEFDAICPHRHPR

SEQ ID NO: 557 - DNA, 874 bp, Corynebacterium glutamicum
  CDS (101)..(874): RXN02213
ttctgtggaatgagaatccgatgtttttctcacgccggctcagccgaagcagacgccgtcgcgaaatctcaccctaaaaaagttagaattggagctcactgtgactgaaagcaagaactccttcaatgctaagagcacccttgaagttggcgacaagtcctatgactacttcgccctctctgcagtgcctggcatggagaagctgccgtactccctcaaggttctcggagagaaccttcttcgtaccgaagacggcgcaaacatcaccaacgagcacattgaggctatcgccaactgggatgcatcttccgatccaagcatcgaaatccagttcaccccagcccgtgttctcatgcaggacttcaccggtgtcccttgtgtagttgacctcgcaaccatgcgtgaggcagttgctgcactcggtggcgaccctaacgacgtcaacccactgaacccagccgagatggtcattgaccactccgtcatcgtggaggctttcggccgcccagatgcactggctaagaacgttgagatcgagtacgagcgcaacgaggagcgttaccagttcctgcgttggggttccgagtccttctccaacttccgcgttgttcctccaggaaccggtatcgtccaccaggtcaacattgagtacttggctcgcgtcgtcttcgacaacgagggccttgcatacccagatacctgcatcggtaccgactcccacaccaccatggaaaacggcctgggcatcctgggctggggcgttggtggcattgaggctgaagcagcaatgctcggccagccagtgtccatgctgatccctcgcgttgttggcttcaagttgaccggcgagatcccagtaggcgttaccgcaact

SEQ ID NO: 558 - protein, 258 aa, Corynebacterium glutamicum
VTESKNSFNAKSTLEVGDKSYDYFALSAVPGMEKLPYSLKVLGENLLRTEDGANITNEHIEAIANWDASSDPSIEIQFTPARVLMQDFTGVPCVVDLATMREAVAALGGDPNDVNPLNPAEMVIDHSVIVEAFGRPDALAKNVEIEYERNEERYQFLRWGSESFSNFRVVPPGTGIVHQVNIEYLARVVFDNEGLAYPDTCIGTDSHTTMENGLGILGWGVGGIEAEAAMLGQPVSMLIPRVVGFKLTGEIPVGVTAT

SEQ ID NO: 559 - DNA, 817 bp, Corynebacterium glutamicum
  CDS (101)..(817): FRXA02213
ttctgtggaatgagaatccgatgtttttctcacgccggctcagccgaagcagacgccgtcgcgaaatctcaccctaaaaaagttagaattggagctcactgtgactgaaagcaagaactccttcaatgctaagagcacccttgaagttggcgacaagtcctatgactacttcgccctctctgcagtgcctggcatggagaagctgccgtactccctcaaggttctcggagagaaccttcttcgtaccgaagacggcgcaaacatcaccaacgagcacattgaggctatcgccaactgggatgcatcttccgatccaagcatcgaaatccagttcaccccagcccgtgttctcatgcaggacttcaccggtgtcccttgtgtagttgacctcgcaaccatgcgtgaggcagttgctgcactcggtggcgaccctaacgacgtcaacccactgaacccagccgagatggtcattgaccactccgtcatcgtggaggctttcggccgcccagatgcactggctaagaacgttgagatcgagtacgagcgcaacgaggagcgttaccagttcctgcgttggggttccgagtccttctccaacttccgcgttgttcctccaggaaccggtatcgtccaccaggtcaacattgagtacttggctcgcgtcgtcttcgacaacgagggccttgcatacccagatacctgcatcggtaccgactcccacaccaccatggaaaacggcctgggcatcctgggctggggcgttggtggcattgaggctgaagcagcaatgctcggccagccagtgtccatgctgatc

SEQ ID NO: 560 - protein, 239 aa, Corynebacterium glutamicum
VTESKNSFNAKSTLEVGDKSYDYFALSAVPGMEKLPYSLKVLGENLLRTEDGANITNEHIEAIANWDASSDPSIEIQFTPARVLMQDFTGVPCVVDLATMREAVAALGGDPNDVNPLNPAEMVIDHSVIVEAFGRPDALAKNVEIEYERNEERYQFLRWGSESFSNFRVVPPGTGIVHQVNIEYLARVVFDNEGLAYPDTCIGTDSHTTMENGLGILGWGVGGIEAEAAMLGQPVSMLI

SEQ ID NO: 561 - DNA, 2891 bp, Corynebacterium glutamicum
  CDS (1)..(2868): RXA02056
cgccactctgttccacgtctaaccaagggccagggcaccatcatcggtgtcggttccatggattacccagcagagttccagggcgcttcagaagaccgccttgcagagctcggcgttggcaaacttgtcaccatcacctccacctacgatcaccgcgtgatccagggtgctgtgtccggtgaattcctgcgcaccatgtctcgcctgctcaccgatgattccttctgggatgagatcttcgacgcaatgaacgttccttacaccccaatgcgttgggcacaggacgttccaaacaccggtgttgataagaacacccgcgtcatgcagctcattgaggcataccgctcccgtggacacctcatcgctgacaccaacccactttcatgggttcagcctggcatgccagttccagaccaccgcgacctcgacatcgagacccacaacctgaccatctgggatctggaccgtaccttcaacgtcggtggcttcggcggcaaggagaccatgaccctgcgcgaggtactgtcccgcctccgcgctgcgtacaccctcaaggtcggctccgaatacacccacatcctggaccgcgacgagcgcacctggctgcaggaccgcctcgaggccggaatgccaaagccaacccaggcagagcagaagtacatcctgcagaagctgaacgccgcggaggctttcgagaacttcctgcagaccaagtacgtcggccagaagcgcttctccctcgaaggtgcagaagcacttatcccactgatggactccgccatcgacaccgccgcaggccaaggcctcgacgaagttgtcatcggtatgccacaccgtggtcgcctcaacgtgctgttcaacatcgtgggcaagccactggcatccatcttcaacgagtttgaaggccaaatggagcagggccagatcggtggctccggtgacgtgaagtaccacctcggttccgaaggccagcacctgcagatgttcggcgacggcgagatcaaggtctccctgactgctaacccgtcccacctggaagctgttaacccagcgatggaaggtattgtccgcgcaaagcaggactacctggacaagggcgtagacggcaagactgttgtgccactgctgctccacggtgacgctgcattcgcaggcctgggcatcgtgccagaaaccatcaacctggctaagctgcgtggctacgacgtcggcggcaccatccacatcgtggtgaacaaccagatcggcttcaccaccaccccagactccagccgctccatgcactacgcaaccgactacgccaaggcattcggctgcccagtcttccacgtcaacggcgacgacccagaggcagttgtctgggttggccagctggccaccgagtaccgtcgtcgcttcggcaaggacgtcttcatcgacctcgtctgctaccgcctccgcggccacaacgaagctgatgatccttccatgacccagccaaagatgtatgagctcatcaccggccgcgagaccgttcgtgctcagtacaccgaagacctgctcggacgtggagacctctccaacgaagatgcagaagcagtcgtccgcgacttccacgaccagatggaatctgtgttcaacgaagtcaaggaaggcggcaagaagcaggctgaggcacagaccggcatcaccggctcccagaagcttccacacggccttgagaccaacatctcccgtgaagagctcctggaactgggacaggctttcgccaacaccccagaaggcttcaactaccacccacgtgtggctcccgttgctaagaagcgcgtctcctctgtcaccgaaggtggcatcgactgggcatggggcgagctcctcgccttcggttccctggctaactccggccgcttggttcgccttgcaggtgaagattcccgccgcggtaccttcacccagcgccacgcagttgccatcgacccagcgaccgctgaagagttcaacccactccacgagcttgcacagtccaagggcaacaacggtaagttcctggtctacaactccgcactgaccgagtacgcaggcatgggcttcgagtacggctactccgtaggaaacgaagactccatcgttgcatgggaagcacagttcggcgacttcgccaacggcgctcagaccatcatcgatgagtacgtctcctcaggcgaagctaagtggggccagacctccaagctgatccttctgctgcctcacggctacgaaggccagggcccagaccactcttccgcacgtatcgagcgcttcctgcagctgtgcgctgagggttccatgactgttgctcagccatccaccccagcaaaccacttccacctactgcgtcgtcacgctctgtccgacctgaagcgtccactggttatcttcaccccgaagtccatgctgcgtaacaaggctgctgcctccgcaccagaagacttcactgaggtcaccaagttccagtccgtgatcaacgatccaaacgttgcagatgcagccaaggtgaagaaggtcatgctggtctccggcaagctgtactacgaattggcaaagcgcaaggagaaggacggacgcgacgacatcgcgatcgttcgtatcgaaatgctccacccaattccgttcaaccgcatctccgaggctcttgccggctaccctaacgctgaggaagtcctcttcgttcaggatgagccagcaaaccagggcccatggccgttctaccaggagcacctcccagagctgatcccgaacatgccaaagatgcgccgcgtttcccgccgcgctcagtcctccaccgcaactggtgttgccaaggtgcaccagctggaggagaagcagcttatcgacgaggctttcgaggcttaagtctttatagtcctgcacta

SEQ ID NO: 562 - protein, 956 aa, Corynebacterium glutamicum
RHSVPRLTKGQGTIIGVGSMDYPAEFQGASEDRLAELGVGKLVTITSTYDHRVIQGAVSGEFLRTMSRLLTDDSFWDEIFDAMNVPYTPMRWAQDVPNTGVDKNTRVMQLIEAYRSRGHLIADTNPLSWVQPGMPVPDHRDLDIETHNLTIWDLDRTFNVGGFGGKETMTLREVLSRLRAAYTLKVGSEYTHILDRDERTWLQDRLEAGMPKPTQAEQKYILQKLNAAEAFENFLQTKYVGQKRFSLEGAEALIPLMDSAIDTAAGQGLDEVVIGMPHRGRLNVLFNIVGKPLASIFNEFEGQMEQGQIGGSGDVKYHLGSEGQHLQMFGDGEIKVSLTANPSHLEAVNPAMEGIVRAKQDYLDKGVDGKTVVPLLLHGDAAFAGLGIVPETINLAKLRGYDVGGTIHIVVNNQIGFTTTPDSSRSMHYATDYAKAFGCPVFHVNGDDPEAVVWVGQLATEYRRRFGKDVFIDLVCYRLRGHNEADDPSMTQPKMYELITGRETVRAQYTEDLLGRGDLSNEDAEAVVRDFHDQMESVFNEVKEGGKKQAEAQTGITGSQKLPHGLETNISREELLELGQAFANTPEGFNYHPRVAPVAKKRVSSVTEGGIDWAWGELLAFGSLANSGRLVRLAGEDSRRGTFTQRHAVAIDPATAEEFNPLHELAQSKGNNGKFLVYNSALTEYAGMGFEYGYSVGNEDSIVAWEAQFGDFANGAQTIIDEYVSSGEAKWGQTSKLILLLPHGYEGQGPDHSSARIERFLQLCAEGSMTVAQPSTPANHFHLLRRHALSDLKRPLVIFTPKSMLRNKAAASAPEDFTEVTKFQSVINDPNVADAAKVKKVMLVSGKLYYELAKRKEKDGRDDIAIVRIEMLHPIPFNRISEALAGYPNAEEVLFVQDEPANQGPWPFYQEHLPELIPNMPKMRRVSRRAQSSTATGVAKVHQLEEKQLIDEAFEA

SEQ ID NO: 563 - DNA, 1517 bp, Corynebacterium glutamicum
  CDS (1)..(1494): RXA01745
atccttgcagacgaagacgacaccgtcgacgtcggcgcagtcatcgcccgcatcggtgacgcaaacgcagctgcagcacctgccgaagaggaagcagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaggaaccagttaaggaagagccaaagaaggaagagcccaagaaggaagagcccaagaaggaagcagctactacacctgctgcggcatccgcaactgtgtccgcttctggcgacaacgttccatacgtcaccccactggtgcgcaagcttgctgaaaagcacggcgttgacttgaacaccgtgaccggtaccggtatcggtggccgtatccgcaagcaggatgttttggctgctgcgaacggcgaggctgcacctgctgaggctgctgctcctgtttccgcttggtccactaagtctgttgaccctgagaaggctaagctccgtggtaccactcagaaggtcaaccgcatccgtgagatcaccgcgatgaagaccgtcgaggctctgcagatttctgctcagctcacccagctgcacgaggtcgatatgactcgcgttgctgagctgcgtaagaagaacaagcccgcgttcatcgagaagcacggtgtgaacctcacttacctgccattcttcgtgaaggcagttgtcgaggctttggtttcccatccaaacgtcaacgcgtctttcaacgcgaagaccaaggagatgacctaccactcctccgttaacctctccatcgctgttgataccccagctggtctgttgaccccagtcattcacgatgctcaggatctctccatcccagagatcgcaaaggcaattgttgacctggctgatcgttcacgcaacaacaagctgaagccaaacgatctgtccggtggcaccttcaccatcaccaacattggttctgaaggcgcactgtctgataccccaatcctggttccaccacaggctggcatcttgggcaccggcgcgatcgtgaagcgtccagttgtcatcaccgaggatggaattgattccatcgcgatccgtcagatggtcttcctaccactgacctacgaccaccaggttgtagatggcgcagatgctggtcgcttcctgaccaccatcaaggaccgccttgagaccgctaacttcgaaggcgatctgcagctctaagatctctgcaagttaaaacc

SEQ ID NO: 564 - protein, 498 aa, Corynebacterium glutamicum
ILADEDDTVDVGAVIARIGDANAAAAPAEEEAAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEEPKKEEPKKEAATTPAAASATVSASGDNVPYVTPLVRKLAEKHGVDLNTVTGTGIGGRIRKQDVLAAANGEAAPAEAAAPVSAWSTKSVDPEKAKLRGTTQKVNRIREITAMKTVEALQISAQLTQLHEVDMTRVAELRKKNKPAFIEKHGVNLTYLPFFVKAVVEALVSHPNVNASFNAKTKEMTYHSSVNLSIAVDTPAGLLTPVIHDAQDLSIPEIAKAIVDLADRSRNNKLKPNDLSGGTFTITNIGSEGALSDTPILVPPQAGILGTGAIVKRPVVITEDGIDSIAIRQMVFLPLTYDHQVVDGADAGRFLTTIKDRLETANFEGDLQL

SEQ ID NO: 565 - DNA, 1005 bp, Corynebacterium glutamicum
  CDS (101)..(982): RXA00782
gggtatggatgcagcggctgatcacgctgcccatttggccaatcttgcccagcacggccagttcgcaaccgctaattagttaaggagcacctgtttaatcatgtctatttttctcaattcagattcccgcatcatcattcagggcattaccggttcggaaggttcagagcatgcgcgtcgaattttagcctctggtgcgaagctcgtgggtggcaccaacccccgcaaagctgggcaaaccattttgatcaatgacactgagttgcctgtatttggcactgttaaggaagcaatggaggaaacgggtgcggatgtcaccgtaattttcgttcctccagcctttgccaaagctgcgatcattgaagctatcgacgctcacatcccactgtgcgtgattattactgagggcatcccagtgcgtgacgcttctgaggcgtgggcttatgccaagaaggtgggacacacccgcatcattggccctaactgcccaggcattattactcccggcgaatctcttgcgggaattacgccggcaaacattgcaggttccggcccgatcgggttgatctcaaagtcgggaacactgacttatcagatgatgtacgaactttcagatattggcatttctacggcgattggtattggcggtgacccaatcatcggtacaacccatatcgacgctctggaggcctttgaagctgatcctgagaccaaggcaatcgtcatgatcggtgagatcggtggagatgcagaggaacgcgctgctgacttcatttctaagcacgtgacaaaaccagttgtgggttacgtggcaggctttaccgcccctgaaggaaagaccatggggcatgctggcgccatcgtgacaggttcagaaggcactgcgcgagcaaagaagcatgcattggaggccgtgggtgttcgcgtgggaacaactccgagtgaaaccgcgaagcttatgcgtgaggtagttgcagctttgtaactaacaggccacagatctta

SEQ ID NO: 566 - protein, 294 aa, Corynebacterium glutamicum
MSIFLNSDSRIIIQGITGSEGSEHARRILASGAKLVGGTNPRKAGQTILINDTELPVFGTVKEAMEETGADVTVIFVPPAFAKAAIIEAIDAHIPLCVIITEGIPVRDASEAWAYAKKVGHTRIIGPNCPGIITPGESLAGITPANIAGSGPIGLISKSGTLTYQMMYELSDIGISTAIGIGGDPIIGTTHIDALEAFEADPETKAIVMIGEIGGDAEERAADFISKHVTKPVVGYVAGFTAPEGKTMGHAGAIVTGSEGTARAKKHALEAVGVRVGTTPSETAKLMREVVAAL

SEQ ID NO: 567 - DNA, 1395 bp, Corynebacterium glutamicum
  CDS (101)..(1372): RXA00783
aaagttcccaaggggtgggggctgagcaccacggatccaattttgttgcaatttgcaaagtttacagtgttagacttcacaatacgatcatattggtgagttgaaacacttacttttacgggaagactttgttaaagacgcagaaggctctaagcatgggccggaaatggaattggcagtggatctttttgaataccaagcacgggacctctttgaaacccatggtgtgccagtgttgaagggaattgtggcatcaacaccagaggcggcgaggaaagcggctgaggaaatcggcggactgaccgtcgtcaaggctcaggtcaaggtgggcggacgtggcaaggcgggtggcgtccgtgtggcaccgacgtcggctcaggcttttgatgctgcggatgcgattctcggcatggatatcaaaggacacactgttaatcaggtgatggtggcgcagggcgctgacattgctgaggaatactatttctccattttgttggatcgcgcgaatcgttcgtatctggctatgtgctctgttgaaggtggcatggagatcgagatcctggcgaaggaaaagcctgaagctttggcaaaggtggaagtggatcccctcactggtattgatgaggacaaagcgcgggagattgtcactgctgctggctttgaaactgaggtggcagagaaagtcattccggtgctgatcaagatctggcaggtgtattacgaagaggaagcaacactcgttgaggtgaacccgttggtgctcacggatgacggcgatgtgattgcgcttgatggcaagatcacgctggatgataacgctgatttccgccatgataaccgtggtgcgttggctgaatctgccggtggcttggacattttggaactgaaggccaagaagaatgatctgaactacgtgaaacttgatggctctgtgggcatcattggcaatggtgcaggtttggtgatgtccacgttggatatcgtggctgcagctggtgaacgccatggtgggcagcgccccgcgaacttcctagacattggtggcggagcatcagctgaatcgatggctgctggtctcgatgtgatccttggggatagccaggtacgcagtgtgtttgtgaatgtgtttggtggcatcaccgcgtgtgatgtggtggcaaagggaatcgttggagctttggatgtgctcggcgatcaagcaacgaagcctcttgtggtgcgccttgatggcaacaacgtggtggaaggcagacgaatcctcgcggaatataaccaccctttggtcaccgttgtggagggtatggatgcagcggctgatcacgctgcccatttggccaatcttgcccagcacggccagttcgcaaccgctaattagttaaggagcacctgtttaat

SEQ ID NO: 568 - protein, 424 aa, Corynebacterium glutamicum
LKHLLLREDFVKDAEGSKHGPEMELAVDLFEYQARDLFETHGVPVLKGIVASTPEAARKAAEEIGGLTVVKAQVKVGGRGKAGGVRVAPTSAQAFDAADAILGMDIKGHTVNQVMVAQGADIAEEYYFSILLDRANRSYLAMCSVEGGMEIEILAKEKPEALAKVEVDPLTGIDEDKAREIVTAAGFETEVAEKVIPVLIKIWQVYYEEEATLVEVNPLVLTDDGDVIALDGKITLDDNADFRHDNRGALAESAGGLDILELKAKKNDLNYVKLDGSVGIIGNGAGLVMSTLDIVAAAGERHGGQRPANFLDIGGGASAESMAAGLDVILGDSQVRSVFVNVFGGITACDVVAKGIVGALDVLGDQATKPLVVRLDGNNVVEGRRILAEYNHPLVTVVEGMDAAADHAAHLANLAQHGQFATAN

SEQ ID NO: 569 - DNA, 1623 bp, Corynebacterium glutamicum
  CDS (101)..(1600): RXN01695
tatggccaacacttgcattcgggtgctggcgatcatttatgagatgacgccttgtgttggtgttcggcagagaactcgcggagataaaaggaagttgaacatgtcagattccccgaagaacgcaccgaggattaccgatgaggcagatgtagttctcattggtgccggtatcatgagctccacgctgggtgcaatgctgcgtcagctggagccaagctggactcagatcgtcttcgagcgtttggatggaccggcacaagagtcgtcctccccgtggaacaatgcaggaaccggccactctgctctatgcgagctgaactacaccccagaggttaagggcaaggttgaaattgccaaggctgtaggaatcaacgagaagttccaggtttcccgtcagttctggtctcacctcgttgaagagggagtgctgtctgatcctaaggaattcatcaaccctgttcctcacgtatctttcggccagggcgcagatcaggttgcatacatcaaggctcgctacgaagctttgaaggatcacccactcttccagggcatgacctacgctgacgatgaagctaccttcaccgagaagctgcctttgatggcaaagggccgtgacttctctgatccagtagcaatctcttggatcgatgaaggcaccgacatcaactacggtgctcagaccaagcagtacctggatgcagctgaagttgaaggcactgaaatccgctatggccacgaagtcaagagcatcaaggctgatggcgcaaagtggatcgtgaccgtcaagaacgtacacactggcgacaccaagaccatcaaggcaaacttcgtgttcgtcggcgcaggcggatacgcactggatctgcttcgcagcgcaggcatcccacaggtcaagggcttcgctggattcccagtatccggcctgtggcttcgttgcaccaacgaggaactgatcgagcagcacgcagccaaggtatatggcaaggcatctgttggcgctcctccaatgtctgttcctcaccttgacacccgcgttatcgagggtgaaaagggtctgctctttggaccttacggtggctggacccctaagttcttgaaggaaggctcctacctggacctgttcaagtccatccgcccagacaacattccttcctaccttggcgttgctgctcaggaatttgatctgaccaagtaccttgtcactgaagttctcaaggaccaggacaagcgtatggatgctcttcgcgagtacatgccagaggcacaaaacggcgattgggagaccatcgttgccggacagcgtgttcaggttattaagcctgcaggattccctaagttcggttccctggaattcggcaccaccttgatcaacaactccgaaggcaccatcgccggattgctcggtgcttcccctggagcatccatcgcaccttccgcaatgatcgagctgcttgagcgttgcttcggtgaccgcatgatcgagtggggcgacaagctgaaggacatgatcccttcctacggcaagaagcttgcttccgagccagcactgtttgagcagcagtgggcacgcacccagaagaccctgaagcttgaggaagcctaaatcttctaactgctttcttt

SEQ ID NO: 570 - protein, 500 aa, Corynebacterium glutamicum
MSDSPKNAPRITDEADVVLIGAGIMSSTLGAMLRQLEPSWTQIVFERLDGPAQESSSPWNNAGTGHSALCELNYTPEVKGKVEIAKAVGINEKFQVSRQFWSHLVEEGVLSDPKEFINPVPHVSFGQGADQVAYIKARYEALKDHPLFQGMTYADDEATFTEKLPLMAKGRDFSDPVAISWIDEGTDINYGAQTKQYLDAAEVEGTEIRYGHEVKSIKADGAKWIVTVKNVHTGDTKTIKANFVFVGAGGYALDLLRSAGIPQVKGFAGFPVSGLWLRCTNEELIEQHAAKVYGKASVGAPPMSVPHLDTRVIEGEKGLLFGPYGGWTPKFLKEGSYLDLFKSIRPDNIPSYLGVAAQEFDLTKYLVTEVLKDQDKRMDALREYMPEAQNGDWETIVAGQRVQVIKPAGFPKFGSLEFGTTLINNSEGTIAGLLGASPGASIAPSAMIELLERCFGDRMIEWGDKLKDMIPSYGKKLASEPALFEQQWARTQKTLKLEEA

SEQ ID NO: 571 - DNA, 1039 bp, Corynebacterium glutamicum
  CDS (101)..(1039): FRXA01615
tatggccaacacttgcattcgggtgctggcgatcatttatgagatgacgccttgtgttggtgttcggcagagaactcgcggagataaaaggaagttgaacatgtcagattccccgaagaacgcaccgaggattaccgatgaggcagatgtagttctcattggtgccggtatcatgagctccacgctgggtgcaatgctgcgtcagctggagccaagctggactcagatcgtcttcgagcgtttggatggaccggcacaagagtcgtcctccccgtggaacaatgcaggaaccggccactctgctctatgcgagctgaactacaccccagaggttaagggcaaggttgaaattgccaaggctgtaggaatcaacgagaagttccaggtttcccgtcagttctggtctcacctcgttgaagagggagtgctgtctgatcctaaggaattcatcaaccctgttcctcacgtatctttcggccagggcgcagatcaggttgcatacatcaaggctcgctacgaagctttgaaggatcacccactcttccagggcatgacctacgctgacgatgaagctaccttcaccgagaagctgcctttgatggcaaagggccgtgacttctctgatccagtagcaatctcttggatcgatgaaggcaccgacatcaactacggtgctcagaccaagcagtacctggatgcagctgaagttgaaggcactgaaatccgctatggccacgaagtcaagagcatcaaggctgatggcgcaaagtggatcgtgaccgtcaagaacgtacacactggcgacaccaagaccatcaaggcaaacttcgtgttcgtcggcgcaggcggatacgcactggatctgcttcgcagcgcaggcatcccacaggtcaagggcttcgctggattcccagtatccggcctgtggcttcgttgcaccaacgaggaactgatcgagcagcacgcagccaaggtatatggcaaggcatctgttggcgctcctccaatgtctgttcctcaccttgacacccgcgttatc

SEQ ID NO: 572 - protein, 313 aa, Corynebacterium glutamicum
MSDSPKNAPRITDEADVVLIGAGIMSSTLGAMLRQLEPSWTQIVFERLDGPAQESSSPWNNAGTGHSALCELNYTPEVKGKVEIAKAVGINEKFQVSRQFWSHLVEEGVLSDPKEFINPVPHVSFGQGADQVAYIKARYEALKDHPLFQGMTYADDEATFTEKLPLMAKGRDFSDPVAISWIDEGTDINYGAQTKQYLDAAEVEGTEIRYGHEVKSIKADGAKWIVTVKNVHTGDTKTIKANFVFVGAGGYALDLLRSAGIPQVKGFAGFPVSGLWLRCTNEELIEQHAAKVYGKASVGAPPMSVPHLDTRVI

SEQ ID NO: 573 - DNA, 233 bp, Corynebacterium glutamicum
  CDS (1)..(210): FRXA01695
gccggattgctcggtgcttcccctggagcatccatcgcaccttccgcaatgatcgagctgcttgagcgttgcttcggtgaccgcatgatcgagtggggcgacaagctgaaggacatgatcccttcctacggcaagaagcttgcttccgagccagcactgtttgagcagcagtgggcacgcacccagaagaccctgaagcttgaggaagcctaaatcttctaactgctttcttt

SEQ ID NO: 574 - protein, 70 aa, Corynebacterium glutamicum
AGLLGASPGASIAPSAMIELLERCFGDRMIEWGDKLKDMIPSYGKKLASEPALFEQQWARTQKTLKLEEA

SEQ ID NO: 575 - DNA, 1063 bp, Corynebacterium glutamicum; identical to SEQ ID NO: 127
  CDS (101)..(1063): RXA00290

SEQ ID NO: 576 - protein, 321 aa, Corynebacterium glutamicum; identical to SEQ ID NO: 128

SEQ ID NO: 577 - DNA, 1347 bp, Corynebacterium glutamicum; identical to SEQ ID NO: 123
  CDS (101)..(1324): RXN01048

SEQ ID NO: 578 - protein, 408 aa, Corynebacterium glutamicum; identical to SEQ ID NO: 124

SEQ ID NO: 579 - DNA, 311 bp, Corynebacterium glutamicum; identical to SEQ ID NO: 125
  CDS (1)..(288): FRXA01048

SEQ ID NO: 580 - protein, 96 aa, Corynebacterium glutamicum; identical to SEQ ID NO: 126

SEQ ID NO: 581 - DNA, 1063 bp, Corynebacterium glutamicum; identical to SEQ ID NO: 127
  CDS (101)..(1063): FRXA00290

SEQ ID NO: 582 - protein, 321 aa, Corynebacterium glutamicum; identical to SEQ ID NO: 128

SEQ ID NO: 583 - DNA, 582 bp, Corynebacterium glutamicum
  CDS (1)..(582): RXN03101
atccttgcagacgaagacgacaccgtcgacgtcggcgcagtcatcgcccgcatcggtgacgcaaacgcagctgcagcacctgccgaagaggaagcagctcctgccgaagaggaagaaccagttaaggaagagccaaagaaggaggcagctcctgaagctccagcagcaactggcgccgcaaccgatgtggaaatgccagaactcggcgaatccgtcaccgaaggcaccattacccagtggctcaaggctgtcggcgacaccgtcgaagtagacgaaccacttcttgaggtctccaccgacaaggtcgacaccgaaatcccatccccagtagcaggcaccatcgtggagatccttgcagacgaagacgacaccgtcgacgtcggcgcagtcatcgcccgcatcggtgacgcaaacgcagctgcagcacctgccgaagaggaagcagctcctgccgaagaggaggaaccagttaaggaagagccaaagaaggaagagcccaagaaggaagagcccaagaaggaagcagctactacacctgctgcggcatccgcaactgtgtccgcttctggcgacaacgttcca

SEQ ID NO: 584 - protein, 194 aa, Corynebacterium glutamicum
ILADEDDTVDVGAVIARIGDANAAAAPAEEEAAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEEPKKEEPKKEAATTPAAASATVSASGDNVP

SEQ ID NO: 585 - DNA, 540 bp, Corynebacterium glutamicum
  CDS (101)..(517): RXN02046
tccgtgccatcaccaccggcgagatcactggcatcgtggacgcaaaacaaacagcaacagaaattattaacatccgacgcaacgcttcaggagagtcctcatgaaagagacactgaccaccggtttaacccaccaaatgacctacatagtgccagcaaaccgcacagttccgcatctgcttcccgaagcagcagaatttgaaaccatgccagatgtcctggccactggatatatggtcggcatcatcgagtgggcctgcatggaacttctgcgtccccatttggacgacggtgaaatctcgctgggcactcatgtgaacttctcccacgcagctccaacggttcctggatccacggtcaccatcgatgttgaggtgacagagatcaaccgtcgtgcagttaccttcaacatcactgcagctgatgagttcgccaccatcagcaccggcacccaccagcgcggtgtggttaaccgtgagaagtttgtctcccgtctgcctgaagcacctaaggaaaactaaatcatggccaagttgtttga

SEQ ID NO: 586 - protein, 139 aa, Corynebacterium glutamicum
MKETLTTGLTHQMTYIVPANRTVPHLLPEAAEFETMPDVLATGYMVGIIEWACMELLRPHLDDGEISLGTHVNFSHAAPTVPGSTVTIDVEVTEINRRAVTFNITAADEFATISTGTHQRGVVNREKFVSRLPEAPKEN

SEQ ID NO: 587 - DNA, 1683 bp, Corynebacterium glutamicum
  CDS (101)..(1660): RXN00389
ccaccactgcgtaacctttccgagcaagatatcgcggacctgtcggatttgcttgccacctctggcgcaggttcctaccgccttcagttgaggtgaaagcatgatcaccgcaaccgcactgcatgggtgttcactgattgatggcgagtgggtcgctggaaaaaatggtgagattacaggattcgatccgcgcaccaatgcgagtctgaacccttcctactctttagcaaacagcgcacagctgcgcgccgccacaacatcggcgaagcgagcttttgaaagctaccgactcactactccagaggttagagcagatttcctggattccatcgctgacaacatcgatgcgctatccggcgagatcgtgcaacgggcgagcctggagacaggtttgggaactacccgactcacaggcgaagtagcccgcaccagcaaccagctccgcctgtttgcagaaaccgtgagaagcggacagttccaccgagtacgcattgaacgaggaccgcggattgatcttcgccagcgtcaggttccgttgggaccagtcgcggtattcggggcaagcaacttccccgtcgctttctctactgctggtggcgatacagcatcagcgttggctgcaggctgccctgtggtttttaaggcgcataatgcgcaccctggaacagctgagctcgtcgggcaagcggtgcggggagccgtcgaaaagcatgagtttgatgctggtgtgtttaaccttgtctacggccgtggcgtggaaattggccaggagctggctgcggatccgaatatcacggcaatcggttttaccggttcacgccagggtggtttggcactgtcacagactgcgtttagccgcccagttcccgttccagtctttgcagaaatgagtgccaccaaccctgtgttcgtcttccccggcgcgctggcggatttggatgcatcgagttccttggctgaggcgtttaccgcttccgtcaccggcagttccgggcaattgtgcaccaagcctggcctcgttttcatcccgcgcggtgttgttggtgatgcttttgtggcgctcgtagcagccaaatttaaagaaaccacgggtcaaacgatgctcacgcaaggcatcgctcaggcatggcagcgcggagtcgacaaccttgcagcacagccaagtgtaaaaatcctcgcccaaggcacccccggagatggagagaacgcgccgggcccggtggtgtttgaaagtgatgtgcaggcgttgctaaataatgtggtgttgcaggaagaaatcttcggtgcggcatcgctggtggtgcgttatgattccccggatcaactccaccaagtagccaattcactcgagggacaattaacagccacgatccacgcatcccaggatgatttccaggaagtctcgaaacttatccccctcttggaggatctcgcgggccgtgttctttacggcggctggccaacgggtgtggaagttgggcacacggttatccatggaggcccttatccggcgacctcaaatgcgcagtcgacaagtgttggaaccctggcaatcgagagatttatgcgcccggtttcttatcaaactttcccggctgagctgcttccagatccagtttctgaggcgaataaatgggctgtacctcgggaaatagaccgttaatagctggtctttacatttgc

SEQ ID NO: 588 - protein, 520 aa, Corynebacterium glutamicum
MITATALHGCSLIDGEWVAGKNGEITGFDPRTNASLNPSYSLANSAQLRAATTSAKRAFESYRLTTPEVRADFLDSIADNIDALSGEIVQRASLETGLGTTRLTGEVARTSNQLRLFAETVRSGQFHRVRIERGPRIDLRQRQVPLGPVAVFGASNFPVAFSTAGGDTASALAAGCPVVFKAHNAHPGTAELVGQAVRGAVEKHEFDAGVFNLVYGRGVEIGQELAADPNITAIGFTGSRQGGLALSQTAFSRPVPVPVFAEMSATNPVFVFPGALADLDASSSLAEAFTASVTGSSGQLCTKPGLVFIPRGVVGDAFVALVAAKFKETTGQTMLTQGIAQAWQRGVDNLAAQPSVKILAQGTPGDGENAPGPVVFESDVQALLNNVVLQEEIFGAASLVVRYDSPDQLHQVANSLEGQLTATIHASQDDFQEVSKLIPLLEDLAGRVLYGGWPTGVEVGHTVIHGGPYPATSNAQSTSVGTLAIERFMRPVSYQTFPAELLPDPVSEANKWAVPREIDR

SEQ ID NO: 589 - DNA, 1467 bp, Corynebacterium glutamicum
  CDS (101)..(1444): RXN02399
ttgacgcaccaatgcccgatggagcaatgtgtgaaccacgccaccacgcaaaccgatgcacatcacgtcgaaacagtgacagtgcattagctcatactttgtggtcggcaccgcccattgcgaatcagcacttaaggaagtgactttgatgtcaaacgttggaaagccacgtaccgcacaggaaatccagcaggattgggacaccaaccctcgttggaacggcatcacccgcgactacaccgcagaccaggtagctgatctgcagggttccgtcatcgaggagcacactcttgctcgccgcggctcagagatcctctgggacgcagtcacccaggaaggtgacggatacatcaacgcgcttggcgcactcaccggtaaccaggctgttcagcaggttcgtgcaggcctgaaggctgtctacctgtccggttggcaggtcgcaggtgacgccaacctctccggccacacctaccctgaccagtccctctacccagcgaactccgttccaagcgtcgttcgtcgcatcaacaacgcactgctgcgttccgatgaaatcgcacgcaccgaaggcgacacctccgttgacaactgggttgtcccaatcgtcgcggacggcgaagctggcttcggtggagcactcaacgtctacgaactccagaaggcaatgatcgcagctggcgctgcaggcacccactgggaagaccagctcgcttctgaaaagaagtgtggccacctcggcggcaaggttctgatcccaacccagcagcacatccgcaccctgaactctgcccgccttgcagcagacgttgcaaacaccccaactgttgttatcgcacgtaccgacgctgaggcagcaaccctgatcacctctgacgttgatgagcgcgaccaaccattcatcaccggtgagcgcaccgcagaaggctactaccacgtcaagaatggtctcgagccatgtatcgcacgtgcaaagtcctacgcaccatacgcagatatgatctggatggagaccggcacccctgacctggagctcgctaagaagttcgctgaaggcgttcgctctgagttcccagaccagctgctgtcctacaactgctccccatccttcaactggtctgcacacctcgaggcagatgagatcgctaagttccagaaggaactcggcgcaatgggcttcaagttccagttcatcaccctcgcaggcttccactccctcaactacggcatgttcgacctggcttacggatacgctcgcgaaggcatgacctccttcgttgacctgcagaaccgtgagttcaaggcagctgaagagcgtggcttcaccgctgttaagcaccagcgtgaggttggcgcaggctacttcgaccagatcgcaaccaccgttgacccgaactcttctaccaccgctttgaagggttccactgaagaaggccagttccacaactaggacctacaggttctgacaat

SEQ ID NO: 590 - protein, 448 aa, Corynebacterium glutamicum
VVGTAHCESALKEVTLMSNVGKPRTAQEIQQDWDTNPRWNGITRDYTADQVADLQGSVIEEHTLARRGSEILWDAVTQEGDGYINALGALTGNQAVQQVRAGLKAVYLSGWQVAGDANLSGHTYPDQSLYPANSVPSVVRRINNALLRSDEIARTEGDTSVDNWVVPIVADGEAGFGGALNVYELQKAMIAAGAAGTHWEDQLASEKKCGHLGGKVLIPTQQHIRTLNSARLAADVANTPTVVIARTDAEAATLITSDVDERDQPFITGERTAEGYYHVKNGLEPCIARAKSYAPYADMIWMETGTPDLELAKKFAEGVRSEFPDQLLSYNCSPSFNWSAHLEADEIAKFQKELGAMGFKFQFITLAGFHSLNYGMFDLAYGYAREGMTSFVDLQNREFKAAEERGFTAVKHQREVGAGYFDQIATTVDPNSSTTALKGSTEEGQFHN

SEQ ID NO: 591 - DNA, 1419 bp, Corynebacterium glutamicum
  CDS (101)..(1396): FRXA02399
caaaccgatgcacatcacgtcgaaacagtgacagtgcattagctcatactttgtggtcggcaccgcccattgcgaatcagcacttaaggaagtgactttgatgtcaaacgttggaaagccacgtaccgcacaggaaatccagcaggattgggacaccaaccctcgttggaacggcatcacccgcgactacaccgcagaccaggtagctgatctgcagggttccgtcatcgaggagcacactcttgctcgccgcggctcagagatcctctgggacgcagtcacccaggaaggtgacggatacatcaacgcgcttggcgcactcaccggtaaccaggctgttcagcaggttcgtgcaggcctgaaggctgtctacctgtccggttggcaggtcgcaggtgacgccaacctctccggccacacctaccctgaccagtccctctacccagcgaactccgttccaagcgtcgttcgtcgcatcaacaacgcactgctgcgttccgatgaaatcgcacgcaccgaaggcgacacctccgttgacaactgggttgtcccaatcgtcgcggacggcgaagctggcttcggtggagcactcaacgtctacgaactccagaaggcaatgatcgcagctggcgctgcaggcacccactgggaagaccagctcgcttctgaaaagaagtgtggccacctcggcggcaaggttctgatcccaacccagcagcacatccgcaccctgaactctgcccgccttgcagcagacgttgcaaacaccccaactgttgttatcgcacgtaccgacgctgaggcagcaaccctgatcacctctgacgttgatgagcgcgaccaaccattcatcaccggtgagcgcaccgcagaaggctactaccacgtcaagaatggtctcgagccatgtatcgcacgtgcaaagtcctacgcaccatacgcagatatgatctggatggagaccggcacccctgacctggagctcgctaagaagttcgctgaaggcgttcgctctgagttcccagaccagctgctgtcctacaactgctccccatccttcaactggtctgcacacctcgaggcagatgagatcgctaagttccagaaggaactcggcgcaatgggcttcaagttccagttcatcaccctcgcaggcttccactccctcaactacggcatgttcgacctggcttacggatacgctcgcgaaggcatgacctccttcgttgacctgcagaaccgtgagttcaaggcagctgaagagcgtggcttcaccgctgttaagcaccagcgtgaggttggcgcaggctacttcgaccagatcgcaaccaccgttgacccgaactcttctaccaccgctttgaagggttccactgaagaaggccagttccacaactaggacctacaggttctgacaat

SEQ ID NO: 592 - protein, 432 aa, Corynebacterium glutamicum
MSNVGKPRTAQEIQQDWDTNPRWNGITRDYTADQVADLQGSVIEEHTLARRGSEILWDAVTQEGDGYINALGALTGNQAVQQVRAGLKAVYLSGWQVAGDANLSGHTYPDQSLYPANSVPSVVRRINNALLRSDEIARTEGDTSVDNWVVPIVADGEAGFGGALNVYELQKAMIAAGAAGTHWEDQLASEKKCGHLGGKVLIPTQQHIRTLNSARLAADVANTPTVVIARTDAEAATLITSDVDERDQPFITGERTAEGYYHVKNGLEPCIARAKSYAPYADMIWMETGTPDLELAKKFAEGVRSEFPDQLLSYNCSPSFNWSAHLEADEIAKFQKELGAMGFKFQFITLAGFHSLNYGMFDLAYGYAREGMTSFVDLQNREFKAAEERGFTAVKHQREVGAGYFDQIATTVDPNSSTTALKGSTEEGQFHN

SEQ ID NO: 593 - DNA, 2340 bp, Corynebacterium glutamicum
  CDS (101)..(2317): RXN02404
gttttcacaaccgttaacggcgtagccaaacaagaaggattcgcattcttctggtttaggcacaggtcatctaaaacccatgctttaaaaggagccttcaatgactgaacaggaactgttgtctgctcagactgccgacaacgctggaactgacagcaccgaacgcgttgacgcgggcggaatgcaggttgcaaaagttctctacgactttgtaaccgaagcggtactccctcgcgtgggtgtggatgcggaaaagttctggtccggattcgccgccatcgcccgggacctcaccccacgcaaccgcgagctgcttgctcgccgcgatgaactgcagatgcttatcgacgactaccaccgcaacaactccggcaccatcgaccaagaggcgtacgaggatttcctcaaagaaatcggatacttggttgaggagccagaagctgcagaaatccgtacccaaaacgtcgatacggaaatctccagcaccgcaggacctcagctggttgttccaattctgaacgcacgcttcgcgctgaacgctgccaatgctcgctggggttccctctacgatgcgttgtacggcaccaacgccatcccagaaactgatggcgctgaaaagggcaaggagtacaacccggtccgcggccagaaggtcatcgagtggggtcgtgaattcctcgacagcgttgtcccactggacggtgcttcgcatgccgatgttgagaagtacaacatcaccgatggaaagcttgcagcccacattggagatagcgtctaccgactgaaaaaccgtgaatcctaccgtggcttcaccggcaacttccttgatccagaagcaatcctgctggaaaccaacggcctgcacatcgagctgcagatcgatcctgtccacccaatcggcaaggcagacaagactggtctcaaagacatcgttttggaatctgcgatcaccacgatcatggacttcgaagactccgttgcagctgttgatgctgaagacaagaccttaggttactctaactggttcggactcaacaccggcgaactgaaagaagagatgtccaagaacggacgcatcttcacccgtgagctcaacaaggaccgcgtctacattggccgcaatggtaccgagctggttctgcacggtcgttccctgctgttcgtccgcaacgttggtcacctcatgcaaaacccatccatcttgattgatggcgaggagatcttcgaaggcatcatggatgctgtcttgaccactgtttgtgccatcccaggaattgctccgcagaacaagatgcgcaattcccgcaagggctccatctacatcgtgaagcctaagcagcacggccctgaagaagtcgcgttcaccaacgagctcttcggccgcgttgaggatctgcttgatctgccacgccacaccttgaaggttggtgttatggatgaggagcgtcgcacgtccgtgaacctggatgccagcatcatggaagttgctgaccgcttggcattcatcaacactggcttcctggaccgcaccggcgatgaaatccacacctccatggaagcaggcgccatggtgcgcaaggctgatatgcagaccgcaccgtggaagcaggcctacgagaacaacaacgttgatgcaggtattcagcgtggtcttcctggcaaggctcagatcggtaagggcatgtgggcgatgactgaactcatggcagaaatgctggagaagaagatcggccagccacgcgaaggcgccaacactgcatgggttccttcaccaactggtgcgacgctgcacgcaacgcactaccacttggttgatgtgttcaaggttcaagacgaactgcgtgctgccggccgccgcgacagcctgcgcaacattctcaccatttcaaccgcaccaaacaccaattggtctgaggaagagaagaaggaagagatggacaacaactgccagtccatcctcggatacgttgtgcgctgggttgagcacggtgttggttgctccaaggttccagacatccatgacatcgacctcatggaagaccgcgcaacgctgcgtatttcctcgcagatgctggccaactggatccgccatgatgttgtctcgaaggagcaggtcttggagtcactggaacgaatggcagtggtcgtcgacaagcaaaatgcgggcgacgaggcctaccgcgatatggcgccgaagtacgacgcctccctcgccttccaggcggctaaggacttgattttcgaaggcaccaagtccccatcgggctacaccgagcccatcttgcacgcacgccgccgcgagttcaaagcaaaaaactaagcacgcttttcgacgcttac

SEQ ID NO: 594 - protein, 739 aa, Corynebacterium glutamicum
MTEQELLSAQTADNAGTDSTERVDAGGMQVAKVLYDFVTEAVLPRVGVDAEKFWSGFAAIARDLTPRNRELLARRDELQMLIDDYHRNNSGTIDQEAYEDFLKEIGYLVEEPEAAEIRTQNVDTEISSTAGPQLVVPILNARFALNAANARWGSLYDALYGTNAIPETDGAEKGKEYNPVRGQKVIEWGREFLDSVVPLDGASHADVEKYNITDGKLAAHIGDSVYRLKNRESYRGFTGNFLDPEAILLETNGLHIELQIDPVHPIGKADKTGLKDIVLESAITTIMDFEDSVAAVDAEDKTLGYSNWFGLNTGELKEEMSKNGRIFTRELNKDRVYIGRNGTELVLHGRSLLFVRNVGHLMQNPSILIDGEEIFEGIMDAVLTTVCAIPGIAPQNKMRNSRKGSIYIVKPKQHGPEEVAFTNELFGRVEDLLDLPRHTLKVGVMDEERRTSVNLDASIMEVADRLAFINTGFLDRTGDEIHTSMEAGAMVRKADMQTAPWKQAYENNNVDAGIQRGLPGKAQIGKGMWAMTELMAEMLEKKIGQPREGANTAWVPSPTGATLHATHYHLVDVFKVQDELRAAGRRDSLRNILTISTAPNTNWSEEEKKEEMDNNCQSILGYVVRWVEHGVGCSKVPDIHDIDLMEDRATLRISSQMLANWIRHDVVSKEQVLESLERMAVVVDKQNAGDEAYRDMAPKYDASLAFQAAKDLIFEGTKSPSGYTEPILHARRREFKAKN

SEQ ID NO: 595 - DNA, 2159 bp, Corynebacterium glutamicum
  CDS (1)..(2136): FRXA02404
atgcaggttgcaaaagttctctacgactttgtaaccgaagcggtactccctcgcgtgggtgtggatgcggaaaagttctggtccggattcgccgccatcgcccgggacctcaccccacgcaaccgcgagctgcttgctcgccgcgatgaactgcagatgcttatcgacgactaccaccgcaacaactccggcaccatcgaccaagaggcgtacgaggatttcctcaaagaaatcggatacttggttgaggagccagaagctgcagaaatccgtacccaaaacgtcgatacggaaatctccagcaccgcaggacctcagctggttgttccaattctgaacgcacgcttcgcgctgaacgctgccaatgctcgctggggttccctctacgatgcgttgtacggcaccaacgccatcccagaaactgatggcgctgaaaagggcaaggagtacaacccggtccgcggccagaaggtcatcgagtggggtcgtgaattcctcgacagcgttgtcccactggacggtgcttcgcatgccgatgttgagaagtacaacatcaccgatggaaagcttgcagcccacattggagatagcgtctaccgactgaaaaaccgtgaatcctaccgtggcttcaccggcaacttccttgatccagaagcaatcctgctggaaaccaacggcctgcacatcgagctgcagatcgatcctgtccacccaatcggcaaggcagacaagactggtctcaaagacatcgttttggaatctgcgatcaccacgatcatggacttcgaagactccgttgcagctgttgatgctgaagacaagaccttaggttactctaactggttcggactcaacaccggcgaactgaaagaagagatgtccaagaacggacgcatcttcacccgtgagctcaacaaggaccgcgtctacattggccgcaatggtaccgagctggttctgcacggtcgttccctgctgttcgtccgcaacgttggtcacctcatgcaaaacccatccatcttgattgatggcgaggagatcttcgaaggcatcatggatgctgtcttgaccactgtttgtgccatcccaggaattgctccgcagaacaagatgcgcaattcccgcaagggctccatctacatcgtgaagcctaagcagcacggccctgaagaagtcgcgttcaccaacgagctcttcggccgcgttgaggatctgcttgatctgccacgccacaccttgaaggttggtgttatggatgaggagcgtcgcacgtccgtgaacctggatgccagcatcatggaagttgctgaccgcttggcattcatcaacactggcttcctggaccgcaccggcgatgaaatccacacctccatggaagcaggcgccatggtgcgcaaggctgatatgcagaccgcaccgtggaagcaggcctacgagaacaacaacgttgatgcaggtattcagcgtggtcttcctggcaaggctcagatcggtaagggcatgtgggcgatgactgaactcatggcagaaatgctggagaagaagatcggccagccacgcgaaggcgccaacactgcatgggttccttcaccaactggtgcgacgctgcacgcaacgcactaccacttggttgatgtgttcaaggttcaagacgaactgcgtgctgccggccgccgcgacagcctgcgcaacattctcaccatttcaaccgcaccaaacaccaattggtctgaggaagagaagaaggaagagatggacaacaactgccagtccatcctcggatacgttgtgcgctgggttgagcacggtgttggttgctccaaggttccagacatccatgacatcgacctcatggaagaccgcgcaacgctgcgtatttcctcgcagatgctggccaactggatccgccatgatgttgtctcgaaggagcaggtcttggagtcactggaacgaatggcagtggtcgtcgacaagcaaaatgcgggcgacgaggcctaccgcgatatggcgccgaagtacgacgcctccctcgccttccaggcggctaaggacttgattttcgaaggcaccaagtccccatcgggctacaccgagcccatcttgcacgcacgccgccgcgagttcaaagcaaaaaactaagcacgcttttcgacgcttac

SEQ ID NO: 596 - protein, 712 aa, Corynebacterium glutamicum
MQVAKVLYDFVTEAVLPRVGVDAEKFWSGFAAIARDLTPRNRELLARRDELQMLIDDYHRNNSGTIDQEAYEDFLKEIGYLVEEPEAAEIRTQNVDTEISSTAGPQLVVPILNARFALNAANARWGSLYDALYGTNAIPETDGAEKGKEYNPVRGQKVIEWGREFLDSVVPLDGASHADVEKYNITDGKLAAHIGDSVYRLKNRESYRGFTGNFLDPEAILLETNGLHIELQIDPVHPIGKADKTGLKDIVLESAITTIMDFEDSVAAVDAEDKTLGYSNWFGLNTGELKEEMSKNGRIFTRELNKDRVYIGRNGTELVLHGRSLLFVRNVGHLMQNPSILIDGEEIFEGIMDAVLTTVCAIPGIAPQNKMRNSRKGSIYIVKPKQHGPEEVAFTNELFGRVEDLLDLPRHTLKVGVMDEERRTSVNLDASIMEVADRLAFINTGFLDRTGDEIHTSMEAGAMVRKADMQTAPWKQAYENNNVDAGIQRGLPGKAQIGKGMWAMTELMAEMLEKKIGQPREGANTAWVPSPTGATLHATHYHLVDVFKVQDELRAAGRRDSLRNILTISTAPNTNWSEEEKKEEMDNNCQSILGYVVRWVEHGVGCSKVPDIHDIDLMEDRATLRISSQMLANWIRHDVVSKEQVLESLERMAVVVDKQNAGDEAYRDMAPKYDASLAFQAAKDLIFEGTKSPSGYTEPILHARRREFKAKN

SEQ ID NO: 597 - DNA, 873 bp, Corynebacterium glutamicum
  CDS (101)..(850): RXA01089
aaaaattcggttcacaaaaggtttatcagtccagcttaaacccatcgcacgggcgggagaattagactcaaggcacatcacattgaaggagcttcttatcttgtctcgatttgctgccaacctgtcattgacttttactgagctagatttcctggatcgttttgatgccgcttcgaagcatgctttcagtgccgtggagtttcagtacccttacgatttcgatgttcaagagattaaacagcgtgctgattccgcaggtctgcccattgaactgttcaatgccccacctggggatacttttggtcttgcggcactggcttcccctgaagactttcaacaatccatcgagcaggccatcacgtacgccacagtgttgaagccaaagaagatgcatgtcatggctggcatcgcggacgtaacctcagaaaccacggcgcgctatgtggagaatattcgctgggctgcgcagcaactagacaagctcgacgttgtcgttgttattgaaccaattaatcactattcggttcccggttatttcctgcacactttagagcaggcgtattggcttatcgacagcattgcccaccccaatgtgaagatcttattcgatactttccaccttcagcagattcatggcaatctcacccgccgcctgcgcgaggttcatggcgcaggtcttttgggacacgtgcaagtggcctcagttcctgatcgacacgaacctggcactggcgaagtcaatgcggcgtatatcttccaactcctaagcgaactgggatatgacggtgtcatcgctggcgaataccaccctgctggtgaaactacagccggtttgggctggttggagctctagatcgtaagtggtgtcgtacc

SEQ ID NO: 598 - protein, 250 aa, Corynebacterium glutamicum
LSRFAANLSLTFTELDFLDRFDAASKHAFSAVEFQYPYDFDVQEIKQRADSAGLPIELFNAPPGDTFGLAALASPEDFQQSIEQAITYATVLKPKKMHVMAGIADVTSETTARYVENIRWAAQQLDKLDVVVVIEPINHYSVPGYFLHTLEQAYWLIDSIAHPNVKILFDTFHLQQIHGNLTRRLREVHGAGLLGHVQVASVPDRHEPGTGEVNAAYIFQLLSELGYDGVIAGEYHPAGETTAGLGWLEL

SEQ ID NO: 599 - DNA, 897 bp, Corynebacterium glutamicum
  CDS (101)..(874): RXA01886
gcgaagctgcacgcaccgcactactcatcgcactcggcgccatccgaagcgtagaaaccggcgcaaccatcaaccttgctgaaagcatcgaggtttaaccatgacttttaaactcgcagcatgcgcagagatgatctaccaggacctgcctttcgaggagagggtcaagacgatctctgatcagggattcctcgtggaaatttgggactggtccacaaaagacatcgatgcgctcgtggcaacaggcgcggaattttcctccatgacgggctacctgcgcggggatctgattactgaacagggccgcgcggagctcttggcaaccgcttcggagtccttggcggtggcggaaaagctcaactgcccccggctgaatctgcatggaactggccttggaccgcagggactacctgttactcccattgaagtggttaccccagaaatgtggctctacgctgctgaaacgctccgccagatcgctgagctgggggagcgcgcaggcaaggttttcgtgctggaaaacctcaacctcgcagtcgatcaccccggcactccttttgccaaggccactgacactttggcgctggtcaaggctgtcaatcacccgaatctgcgcctcaacctggatttgtaccacgcccagattggcgaaggaaacctcattgagctgctccgtgaggcgcagccattcatcggcgaaatccaggttgccgatgtccccggccgcatggaacccggcaccggcgagatcaactaccagggcgtcgcgaaagctctcgccgcgatgggctacgacggcgtcatcggcatggaggcgtgggcatcgggcgactccagcgacgcgctgcaggcgttgaagtcagcgttcacggtctaaattgcttatcgacgcacccc

SEQ ID NO: 600 - protein, 258 aa, Corynebacterium glutamicum
MTFKLAACAEMIYQDLPFEERVKTISDQGFLVEIWDWSTKDIDALVATGAEFSSMTGYLRGDLITEQGRAELLATASESLAVAEKLNCPRLNLHGTGLGPQGLPVTPIEVVTPEMWLYAAETLRQIAELGERAGKVFVLENLNLAVDHPGTPFAKATDTLALVKAVNHPNLRLNLDLYHAQIGEGNLIELLREAQPFIGEIQVADVPGRMEPGTGEINYQGVAKALAAMGYDGVIGMEAWASGDSSDALQALKSAFTV

SEQ ID NO: 601 - DNA, 1575 bp, Corynebacterium glutamicum
  CDS (41)..(1552): RXN03117
tgtgcaacattagttcgttaagaagagtcacattccagccatgattacccacgaagtgcgcacccaccgttctgcggaagagttcccgtacaagaagcacctggctcacaagatggctcgcgttgcagccgacccagttgaggttgctgcggacactcaggaaatgatcatcacccgcatcatcgacaatgcatcggtgcaggcagcttccgtgttgcgtcgaccagttagctctgcccgtgcgatggcacaggtcaggccagttaccgatggtcggggtgcatctgttttcggtctgccaggacgttatgccgcggaatgggctgcgcttgctaacggcactgcggtgcgtgagcttgatttccatgacacgttcctcgctgcggaatactcccacccaggagataacattcctccgattttggctgcagcacagcaggctggaaaaggtggcaaggatctgatccgtggcatcgctactgggtatgagattcaggttaacttggtgcgtggaatgtgcctgcatgagcacaagattgatcacgttgctcatcttggaccatcagcggctgctggtatcggaaccttgctagacctagatgtggacaccatctaccaggcaattggtcaggcattgcacaccaccacggcgacgaggcagtcccgtaaaggtgcgatttcttcatggaaggcatttgctcctgcgtttgcgggcaagatgtccatcgaggcagtagatcgcgcaatgcgtggcgagggcgcaccgtcaccaatctgggaaggcgaagacggcgtaatcgcgtggctgctgtccggtcttgatcacatctacaccattcctttgcctgcagaaggtgaagccaaacgagcaatcttggatacctacaccaaggaacactcggcggaataccagtcacaggcaccgatcgacttggcgcgcagcatgggggagaagctggcagcacagggcttggacctgcgtgatgtggactccatcgttttgcacacctcccaccacactcactacgtgatcggcaccggatctaatgatccacagaagttcgatccagatgcatcgcgagaaacccttgatcactccatcatgtacattttcgctgtcgcgctgaaggatcgcgcgtggcaccacgagcgttcctatgctcctgagcgagcccaccgccgagagaccatcgagctgtggaacaagatttccacggtggaggatcctgaatggaccaggcgttaccactccgttgatcctgcagaaaaggccttcggcgcacgcgcagtgatcaccttcaaggatggaaccgtcgtggaagatgaactggctgtggcgaatgcgcatcctctgggagcacggcctttcgctagggagcagtacattcagaaattccgcaccttggctgaaggtgttgtgtccgaaaaggaacaggatcgcttcttggatgcggcacagcgtacgcacgagcttgaggatctttcagaactcaacattgaattggatgccgatattttggccaaggctcctgtgattccggaaggactgttctgatggcgggtttgttttcctct

SEQ ID NO: 602 - protein, 504 aa, Corynebacterium glutamicum
MITHEVRTHRSAEEFPYKKHLAHKMARVAADPVEVAADTQEMIITRIIDNASVQAASVLRRPVSSARAMAQVRPVTDGRGASVFGLPGRYAAEWAALANGTAVRELDFHDTFLAAEYSHPGDNIPPILAAAQQAGKGGKDLIRGIATGYEIQVNLVRGMCLHEHKIDHVAHLGPSAAAGIGTLLDLDVDTIYQAIGQALHTTTATRQSRKGAISSWKAFAPAFAGKMSIEAVDRAMRGEGAPSPIWEGEDGVIAWLLSGLDHIYTIPLPAEGEAKRAILDTYTKEHSAEYQSQAPIDLARSMGEKLAAQGLDLRDVDSIVLHTSHHTHYVIGTGSNDPQKFDPDASRETLDHSIMYIFAVALKDRAWHHERSYAPERAHRRETIELWNKISTVEDPEWTRRYHSVDPAEKAFGARAVITFKDGTVVEDELAVANAHPLGARPFAREQYIQKFRTLAEGVVSEKEQDRFLDAAQRTHELEDLSELNIELDADILAKAPVIPEGLF

SEQ ID NO: 603 - DNA, 975 bp, Corynebacterium glutamicum
  CDS (1)..(975): FRXA00406
gacccagttgaggttgctgcggacactcaggaaatgatcatcacccgcatcatcgacaatgcatcggtgcaggcagcttccgtgttgcgtcgaccagttagctctgcccgtgcgatggcacaggtcaggccagttaccgatggtcggggtgcatctgttttcggtctgccaggacgttatgccgcggaatgggctgcgcttgctaacggcactgcggtgcgtgagcttgatttccatgacacgttcctcgctgcggaatactcccacccaggagataacattcctccgattttggctgcagcacagcaggctggaaaaggtggcaaggatctgatccgtggcatcgctactgggtatgagattcaggttaacttggtgcgtggaatgtgcctgcatgagcacaagattgatcacgttgctcatcttggaccatcagcggctgctggtatcggaaccttgctagacctagatgtggacaccatctaccaggcaattggtcaggcattgcacaccaccacggcgacgaggcagtcccgtaaaggtgcgatttcttcatggaaggcatttgctcctgcgtttgcgggcaagatgtccatcgaggcagtagatcgcgcaatgcgtggcgagggcgcaccgtcaccaatctgggaaggcgaagacggcgtaatcgcgtggctgctgtccggtcttgatcacatctacaccattcctttgcctgcagaaggtgaagccaaacgagcaatcttggatacctacaccaaggaacactcggcggaataccagtcacaggcaccgatcgacttggcgcgcagcatgggggagaagctggcagcacagggcttggacctgcgtgatgtggactccatcgttttgcacacctcccaccacactcactacgtgatcggcaccggatctaatgatccacagaagttcgatccagatgcatcgcgagaaacccttgatcactccatcatg

SEQ ID NO: 604 - protein, 325 aa, Corynebacterium glutamicum
DPVEVAADTQEMIITRIIDNASVQAASVLRRPVSSARAMAQVRPVTDGRGASVFGLPGRYAAEWAALANGTAVRELDFHDTFLAAEYSHPGDNIPPILAAAQQAGKGGKDLIRGIATGYEIQVNLVRGMCLHEHKIDHVAHLGPSAAAGIGTLLDLDVDTIYQAIGQALHTTTATRQSRKGAISSWKAFAPAFAGKMSIEAVDRAMRGEGAPSPIWEGEDGVIAWLLSGLDHIYTIPLPAEGEAKRAILDTYTKEHSAEYQSQAPIDLARSMGEKLAAQGLDLRDVDSIVLHTSHHTHYVIGTGSNDPQKFDPDASRETLDHSIM

SEQ ID NO: 605 - DNA, 431 bp, Corynebacterium glutamicum
  CDS (1)..(408): FRXA00514
cacgagcgttcctatgctcctgagcgagccctccgccgagagaccatcgagctgtggaacaagatttccacggtggaggatcctgaatggaccaggcgttaccactccgttgatcctgcagaaaaggccttcggcgcacgcgcagtgatcaccttcaaggatggaaccgtcgtggaagatgaactggctgtggcgaatgcgcatcctctgggagcacggcctttcgctagggagcagtacattcagaaattccgcaccttggctgaaggtgttgtgtccgaaaaggaacaggatcgcttcttggatgcggcacagcgtacgcacgagcttgaggatctttcagaactcaacattgaattggatgccgatattttggccaaggctcctgtgattccggaaggactgttctgatggcgggtttgttttcctct

SEQ ID NO: 606 - protein, 136 aa, Corynebacterium glutamicum
HERSYAPERALRRETIELWNKISTVEDPEWTRRYHSVDPAEKAFGARAVITFKDGTVVEDELAVANAHPLGARPFAREQYIQKFRTLAEGVVSEKEQDRFLDAAQRTHELEDLSELNIELDADILAKAPVIPEGLF

SEQ ID NO: 607 - DNA, 718 bp, Corynebacterium glutamicum
  CDS (101)..(718): RXA00512
tacaacgagtacaacgctttcgaccagcaagtattcacctattccgctgacagctacaagcccatcttctaacccgcctatatataaggagtgaatcaccatgtccagcgccacaaccactgatgttcgcaaagggctctacggagtcatcgccgattacacggccgtttccaaagtcatgccagagaccaattcactgacctaccgtggctacgcggtggaagatttggtggaaaactgcagcttcgaggaggtgttttacctcctgtggcacggcgagctgcccactgcgcaacaacttgcggagttcaatgagcgtggccgttcctaccgctccctggatgccggtttgatctccctgatccactctttgcccaaagaagcccacccgatggatgttatgcgcaccgcggtgtcctacatgggcaccaaggattccgagtatttcaccaccgattctgagcacatccgcaaagttggccacaccttgttggcgcagcttccgatggtgctagccatggatattcgtcgccgcaagggcctcgatatcatcgcccctgactccagcaagtcagtcgccgaaaacctgctgtctatggtgtttggtactggcccggaatcacctgcatccaacccagctgacgtccgcgattttgagaaatcactgatcctctacgccgagcactccttcaacgcctccaccttcaccgcccgcgtg

SEQ ID NO: 608 - protein, 206 aa, Corynebacterium glutamicum
MSSATTTDVRKGLYGVIADYTAVSKVMPETNSLTYRGYAVEDLVENCSFEEVFYLLWHGELPTAQQLAEFNERGRSYRSLDAGLISLIHSLPKEAHPMDVMRTAVSYMGTKDSEYFTTDSEHIRKVGHTLLAQLPMVLAMDIRRRKGLDIIAPDSSKSVAENLLSMVFGTGPESPASNPADVRDFEKSLILYAEHSFNASTFTARV

SEQ ID NO: 609 - DNA, 320 bp, Corynebacterium glutamicum
  CDS (1)..(297): RXA00518
gtccttccggtattagctgcccgccacgacggcgaaaagtgggttgccatgtatgaaaacatgcgcgacgccatggacgcccgcaccggcatcaagccgaatctcgatttccctgctggccctgcctaccacctgctcggtttcccggtcgatttcttcaccccgctgttcgtcatcgcccgcgtcgccggctggacggcccacatcgtggagcagtacgaaaacaactcgctcatccgcccactgtccgagtacaacggcgaggagcagcgcgaggtcgcgcccattgaaaagcgctaaaagattttcgcttttcgacg

SEQ ID NO: 610 - protein, 99 aa, Corynebacterium glutamicum
VLPVLAARHDGEKWVAMYENMRDAMDARTGIKPNLDFPAGPAYHLLGFPVDFFTPLFVIARVAGWTAHIVEQYENNSLIRPLSEYNGEEQREVAPIEKR

SEQ ID NO: 611 - DNA, 1494 bp, Corynebacterium glutamicum
  CDS (101)..(1471): RXA01077
tctatgacttgatccacaatgtgatgcaaatcattgaccctcaccccggaccaagcgcttaatgaaggcaagccaaacttaactagtagataggattgcaatgaccgaatcgcaagatctcgccgcattcgtggaagctgccaaactcaatgatgcaagccccgaagccgtagagcaattgaaaatcagagtgctagacaccgtaggcgttgccattggcgcactggatgccgaaccgattgtcgccattcgaggactcctggaagacctcgggggaaccgaacagtcaacacttattggtggtggcaaaaccagtccggaacgtgcagcatttttcaacagcgcattaagccgctacctcgacttcatggacgcctacctagcaaagggcgaaaccaaccacccctcggataacttcggagcagtgctcgctgcagccgaaagcgttggcgcctctggaaaagacctgctcaccgcattcgccgtggcctaccaggtacacaccagactttcagatgtcgcaccagttcgcgccaaaggtttcgatcacaccacccaaggagcattcgcagcgggcgcatctgctgccaaggcactgggtttgccagctgatcaaatcgccaacgcactggccatcgcaggaacagccaatgttgcacttcgtgtcactcgcactggaaacttgagccactggaaaggccttgcctacccacacgtgtccaaagaaggaacctgggcagcactgctcgcaagccgaggtattaccggtccggaagaagtcttcgaaggcaacaagggattcaaagagtccgtctccggaccgttcgagatcgattggtccaaggaagacttggaaagcgttaagcgcaccatcatcaagaaacacaacgcggaaattcactcgcagtcagcgcttgatgcagcccaagaaatacgcgcacaagaaggcttcaatgtggacaacattgaaaagattcacctgactactttcgacgttgcctactccatcattggcggcggcgaagaaggcgacaaacagcttattcgcaccaaagaagaagccgatcactcactgccgtggatgctcgctgtagttctgctggatggtcagctcaatcccgaacagtacgaaccatcacgcatcgttgctgatgatgtacaaaccttgatgaagaaaatcgaaatcacaccgtcagatgaattctctgatcgcttccctgaccacatgccagctgatctagaagtcacactaaacgatggctcggtgttcaaagcttcacaagatagctacttaggcttccacgacaatcccctagattgggacaacgcgcgcaagaaattcgatgcccttgtcacaccattcaccggtgaagaactacgtgaagaaatcgccacgatcattcacgagctcgatagccgacaggtttctgaactcacagaagccctggccaaagtctccaccacccgcagctaaaactttttgaaaggagctca

SEQ ID NO: 612 - protein, 457 aa, Corynebacterium glutamicum
MTESQDLAAFVEAAKLNDASPEAVEQLKIRVLDTVGVAIGALDAEPIVAIRGLLEDLGGTEQSTLIGGGKTSPERAAFFNSALSRYLDFMDAYLAKGETNHPSDNFGAVLAAAESVGASGKDLLTAFAVAYQVHTRLSDVAPVRAKGFDHTTQGAFAAGASAAKALGLPADQIANALAIAGTANVALRVTRTGNLSHWKGLAYPHVSKEGTWAALLASRGITGPEEVFEGNKGFKESVSGPFEIDWSKEDLESVKRTIIKKHNAEIHSQSALDAAQEIRAQEGFNVDNIEKIHLTTFDVAYSIIGGGEEGDKQLIRTKEEADHSLPWMLAVVLLDGQLNPEQYEPSRIVADDVQTLMKKIEITPSDEFSDRFPDHMPADLEVTLNDGSVFKASQDSYLGFHDNPLDWDNARKKFDALVTPFTGEELREEIATIIHELDSRQVSELTEALAKVSTTRS

SEQ ID NO: 613 - DNA, 923 bp, Corynebacterium glutamicum
  CDS (1)..(900): RXN03144
accacgacggctaccaggcagtcgcgaaaaggtgagatttccagctggaaggcgttcgcgccagcgtttgcgggaaagatggccattgaggcgatggatcgtgcgatgcgtggggagggttcgcccgcaccgatttgggagggcgaagacggggtcatcgcgtggctgttatcgggcaaagatcatgtttatcatgtgccattgccggaacacggcgagcccaagctggggattctagagacttacacaaaggaacattcagcggaatatcaatcgcaggcaccgattgatctggcgcgcaggatgaagccactggttgacgcggctggcggaacggaacacattgcagagattgtgctgcgcaccagtcaccacacgcattatgtgattggcactggggcgaacgatccgcagaagatggatccgcaggcctcgcgtgaaaccctggatcattccatcatgtacattttcgccgtcgcgcttcaagatggcgtgtggcaccacgagttttcctacacccgcaagcgttccacccgcccggaaactgtggagctgtggcacaagattcgcaccgtggaggatcctgaatggacgcgccgataccattctgatgatcctgcaaaaaaggcctttggtgcgaaagcagtgatcacaatggctgatggcaccgtgattgaggatgaattggctgtcgcggatgcccacccgctgggtgctcggccgtttgcgcgggagaattacattgaaaaattccgcacactcgcgcaggggattgtcattgattcagaacaggaacgcttcttgcatgccgtgcaaagcctgcctgacctggatgatcttgatcagctcaacatcgaagtcgacataagcaaccaggccgcgacgaaagcggggctgttatgaatctcttttcgaatggtgtt

SEQ ID NO: 614 - protein, 300 aa, Corynebacterium glutamicum
TTTATRQSRKGEISSWKAFAPAFAGKMAIEAMDRAMRGEGSPAPIWEGEDGVIAWLLSGKDHVYHVPLPEHGEPKLGILETYTKEHSAEYQSQAPIDLARRMKPLVDAAGGTEHIAEIVLRTSHHTHYVIGTGANDPQKMDPQASRETLDHSIMYIFAVALQDGVWHHEFSYTRKRSTRPETVELWHKIRTVEDPEWTRRYHSDDPAKKAFGAKAVITMADGTVIEDELAVADAHPLGARPFARENYIEKFRTLAQGIVIDSEQERFLHAVQSLPDLDDLDQLNIEVDISNQAATKAGLL

SEQ ID NO: 615 - DNA, 511 bp, Corynebacterium glutamicum
  CDS (101)..(511): FRXA02322
cgcgcagagctaaactgcgtgaggttgtggcctgtcacacataatcggcctagggtgggactttaaggaaacagtgcacaaataaatctcaaggagccccatgcgcatccacgatgtttatacccacctttcggccgataactttcccaaagcagagcaccttgcgtggaaattctccgagcttgccaccgaccccgtggaggtgacaccggatgtttcggagatgatcatcaaccggatcatcgacaacgcggcggtgtctgccgcgtcggtgttgcgccggcctgtgactgtggccaggcaacaagcgcagtcccatccgcgggaaaagggcggaaaagtttttggaatttcaggcagctactcaccagagtgggctgcctttgctaatggtgtggccgtacgtgaattggacttccacgatacatttttagcagctgaatactcccatcccggcgacaatattccaccacttcttgcagtagcgcaggctcagagaagcagcggcagg

SEQ ID NO: 616 - protein, 137 aa, Corynebacterium glutamicum
MRIHDVYTHLSADNFPKAEHLAWKFSELATDPVEVTPDVSEMIINRIIDNAAVSAASVLRRPVTVARQQAQSHPREKGGKVFGISGSYSPEWAAFANGVAVRELDFHDTFLAAEYSHPGDNIPPLLAVAQAQRSSGR

SEQ ID NO: 617 - DNA, 603 bp, Corynebacterium glutamicum
  CDS (1)..(603): RXA02329
acggctaccaggcagtcgcgaaaaggtgagatttccagctggaaggcgttcgcgccagcgtttgcgggaaagatggccattgaggcgatggatcgtgcgatgcgtggggagggttcgcccgcaccgatttgggagggcgaagacggggtcatcgcgtggctgttatcgggcaaagatcatgtttatcatgtgccattgccggaacacggcgagcccaagctggggattctagagacttacacaaaggaacattcagcggaatatcaatcgcaggcaccgattgatctggcgcgcaggatgaagccactggttgacgcggctggcggaacggaacacattgcagagattgtgctgcgcaccagtcaccacacgcattatgtgattggcactggggcgaacgatccgcagaagatggatccgcaggcctcgcgtgaaaccctggatcattccatcatgtacattttcgccgtcgcgcttcaagatggcgtgtggcaccacgagttttcctacacccgcaagcgttccacccgcccggaaactgtggagctgtggcacaagattcgcaccgtggaggatcctgaatggacgcgccgataccattct

SEQ ID NO: 618 - protein, 201 aa, Corynebacterium glutamicum
TATRQSRKGEISSWKAFAPAFAGKMAIEAMDRAMRGEGSPAPIWEGEDGVIAWLLSGKDHVYHVPLPEHGEPKLGILETYTKEHSAEYQSQAPIDLARRMKPLVDAAGGTEHIAEIVLRTSHHTHYVIGTGANDPQKMDPQASRETLDHSIMYIFAVALQDGVWHHEFSYTRKRSTRPETVELWHKIRTVEDPEWTRRYHS

SEQ ID NO: 619 - DNA, 1266 bp, Corynebacterium glutamicum
  CDS (101)..(1243): RXA02332
gaccgcatgcaacaccgcagcagattatatgagctcctgcgatacgaagactacaacgtctttgaccagcacattttcacctacagaaaaggagaaaacaatgagtgacagccaagtccgcaaaggactcaacggcgtcatctctgactacacaagcatttccaaagtgatgccagagagcaactcgctgacttaccgtggctacgccgtggaggatttggtggaaaactgcagctttgaagaagtgatctacctcctgtggtttggggagctgcccaccactgaacaactccggaccttcaacacgacaggtcgaagctaccgctcactcgacgccggactgatttccctcatccactccttacccaacacctgccaccccatggacgtgctgcgcaccgcagtgtcctacatgggtacctttgatcccgatccgtttacccgcgatgccgatcatatccgaagcattggacacaacctgcttgcgcagcttcccatggtggttgccatggatatccgcaggcgaagtggggaagagatcatcgcacctgaccacaacaaaggtatcgcttcgaatttcttatccatggtgtttggcaatgatgatggttctgtagccaactccgcagatgacatccgcgattttgaacgctccctcatcctctacgccgagcactccttcaacgcctccacattctcagcccgcgtgatctcatcaacgcgatccgatacgtattcggcgatcacaggtgcgatcggtgctctcaaaggcccactgcacggaggtgccaatgagtttgtcatgcacaccatgctggatatcgacgatcccaacaatgctgccgactggatgggcaaggcgttggatcgtaaagaacgcatcatgggattcgggcaccgcgtgtacaaaaacggcgactccagggtcccctccatggagaaatccatgcgctcccttgctgctcgtcaccgtggtcaaaaatgggtgcacatgtatgagtcgatgcaagaagtcatggaggctcgcactggcattaaacccaacctcgacttcccggccggccctgcctattacatgctgggattccccgtcgacttcttcacaccactgtttgtgctggcccgagtgtcagggtggacggcacacatcgtggagcaatttgaaaacaatgcgctgatccgaccattgtctgcctacaacggagtggaagaaagggaggtggtgcccatttcggagagaacctaatcagtgaggctgatttctaa

SEQ ID NO: 620 - protein, 381 aa, Corynebacterium glutamicum
MSDSQVRKGLNGVISDYTSISKVMPESNSLTYRGYAVEDLVENCSFEEVIYLLWFGELPTTEQLRTFNTTGRSYRSLDAGLISLIHSLPNTCHPMDVLRTAVSYMGTFDPDPFTRDADHIRSIGHNLLAQLPMVVAMDIRRRSGEEIIAPDHNKGIASNFLSMVFGNDDGSVANSADDIRDFERSLILYAEHSFNASTFSARVISSTRSDTYSAITGAIGALKGPLHGGANEFVMHTMLDIDDPNNAADWMGKALDRKERIMGFGHRVYKNGDSRVPSMEKSMRSLAARHRGQKWVHMYESMQEVMEARTGIKPNLDFPAGPAYYMLGFPVDFFTPLFVLARVSGWTAHIVEQFENNALIRPLSAYNGVEEREVVPISERT

SEQ ID NO: 621 - DNA, 1038 bp, Corynebacterium glutamicum
  CDS (101)..(1015): RXN02333
tcttgcatgccgtgcaaagcctgcctgacctggatgatcttgatcagctcaacatcgaagtcgacataagcaaccaggccgcgacgaaagcggggctgttatgaatctcttttcgaatggtgttgatgtggggaggcgtcgacaagcatttaaagcggcactcgccgcaccccacatcgcccggctgcccggcgcattctcccctctgattgcgcgctccatcgaagaagccggcttcgaaggcgtctacgtttccggcgccgtcatagctgctgacctggcactacccgatatcggcttgacgacgctgaccgaagtcgcccaccgcgcgcggcaaattgcgcgcgtcacagacctaggagtgcttgtcgacgccgacaccggctttggcgaacccatgtcggccgcacgcaccgtcgccgaattggaggacgccggtgtggccggatgccaccttgaagaccaagtcaaccccaaacgttgcgggcacttggacggcaaagaagtcgtgcgcacagacgtgatggttcgacgcatcgcagccgccgtctcggcccggcgcgacccgaactttgtcatctgcgcccgcaccgacgccgctggagtggaaggaatcgacgccgccattgagcgcgcgaaagcctacttagatgcgggcgccgacatgattttcaccgaagccctccacagcgaagccgacttccgatacttccggcacgccatccctgatgccttgttgctggcgaatatgaccgaatttggcaaaacgacgctgctgtcagccgacgtgttggaagagattggctacaacgccgtgatctaccccgtgaccacgctgcgtattgccatgggacaagtagaacaagcactagccgaaatcaaagaacacggtacccaagaaggatggctggaccgcatgcaacaccgcagcagattatatgagctcctgcgatacgaagactacaacgtctttgaccagcacattttcacctacagaaaaggagaaaacaatgagtgacagccaagtccgcaaaggac

SEQ ID NO: 622 - protein, 305 aa, Corynebacterium glutamicum
MNLFSNGVDVGRRRQAFKAALAAPHIARLPGAFSPLIARSIEEAGFEGVYVSGAVIAADLALPDIGLTTLTEVAHRARQIARVTDLGVLVDADTGFGEPMSAARTVAELEDAGVAGCHLEDQVNPKRCGHLDGKEVVRTDVMVRRIAAAVSARRDPNFVICARTDAAGVEGIDAAIERAKAYLDAGADMIFTEALHSEADFRYFRHAIPDALLLANMTEFGKTTLLSADVLEEIGYNAVIYPVTTLRIAMGQVEQALAEIKEHGTQEGWLDRMQHRSRLYELLRYEDYNVFDQHIFTYRKGENNE

SEQ ID NO: 623 - DNA, 242 bp, Corynebacterium glutamicum
  CDS (1)..(219): FRXA02333
gagattggctacaacgccgtgatctaccccgtgaccacgctgcgtattgccatgggacaagtagaacaagcactagccgaaatcaaagaacacggtacccaagaaggatggctggaccgcatgcaacaccgcagcagattatatgagctcctgcgatacgaagactacaacgtctttgaccagcacattttcacctacagaaaaggagaaaacaatgagtgacagccaagtccgcaaaggac

SEQ ID NO: 624 - protein, 73 aa, Corynebacterium glutamicum
EIGYNAVIYPVTTLRIAMGQVEQALAEIKEHGTQEGWLDRMQHRSRLYELLRYEDYNVFDQHIFTYRKGENNE

SEQ ID NO: 625 - DNA, 513 bp, Corynebacterium glutamicum
  CDS (101)..(490): RXA00030
taaaaacgccactttggtgtcgataacaccgaacttccgaacataaaagatgcgttggtgctctctgcacaatgtttctttcggaactattctggcgaccatgcgaattgaaatcacaagcgtatttgttgatgaccaggccaaagcactcgatttctacaccacgaagctcggatttgagctcaaacacgatgtaactgctggtgactaccgctggttgactgttgttgatccagaaaacccagatggtgtgcagcttttgttggaaccaaaccagcacccagatgcagcgacttaccaagctggaattaaacgagacggtattcccgctacacagttttatgttgatgatgtgcaggaagaatatgacagcctcaaggataaaggcgtggatttcatcatggaaccaaccgatgtgggcccttcagtgattgccattctcgatgacaccgtaggaaacctaattcagattgttcaattgaagcagaactaaccccgtggaatgacaaaatc

SEQ ID NO: 626 - protein, 130 aa, Corynebacterium glutamicum
MRIEITSVFVDDQAKALDFYTTKLGFELKHDVTAGDYRWLTVVDPENPDGVQLLLEPNQHPDAATYQAGIKRDGIPATQFYVDDVQEEYDSLKDKGVDFIMEPTDVGPSVIAILDDTVGNLIQIVQLKQN

SEQ ID NO: 627 - DNA, 2334 bp, Corynebacterium glutamicum
  CDS (101)..(2311): RXN00148
ctttgagggcagcgcgcatgcgcccgatggttatttgaacatgacaattgatgccgcggcgacgctggctgacctgctagatgctttgggagcttaaatcatgacgtcgatccctaatttttcagacatcccattgactgctgagacacgtgcatcggagtcacacaacgttgacgccggcaaggtgtggaacactcccgaaggcattgatgtcaagcgcgtattcacgcaggctgaccgcgacgaggcgcaagcggcgggacatccggtggattctttgccaggtcaaaagccatttatgcgcgggccgtacccaactatgtacaccaatcagccgtggacgattcgccagtacgcaggcttttcaaccgccgcggaatccaatgcgttttatcggaggaaccttgctgcgggtcaaaaaggtttgtcggttgcgttcgatctagcgacccaccgcggttatgactcggataatgagcgcgtggtcggcgatgtgggtatggccggcgtggcgattgattcgattttggatatgcgtcagctgtttgatggcattgatttgtccagcgtgtcggtgtcgatgaccatgaatggcgctgtgctgccgattcttgcgttctatatcgtggcggctgaggaacaaggtgtgggtccggagcagcttgcgggcacgatccagaatgacatcttgaaagaatttatggtgcgcaacacctatatttatccgccgaagccgtcgatgcgcatcatttccaacatctttgagtacacctccttgaagatgccacgttttaactccatttcgatttctggctatcacatccaggaagcgggagcgactgccgatttggagctggcctacactctggcggatggtattgaatacatccgtgcaggtaaagaggtaggccttgacgtggataagttcgcgcctcgtctgtccttcttctggggtatttctatgtacaccttcatggagatcgcaaagctgcgtgcgggacgactgctgtggagcgagttggtggcaaaattcgatccgaaaaacgccaagtcccagtcgctgcgcacgcactcgcagacctctggttggtcgttgaccgcgcaggatgtgtacaacaacgtcgcccgcaccgcgattgaggcgatggctgcaacccagggccacacccagtcgctgcacaccaatgcacttgatgaggcgttggcgctgcccaccgatttctctgctcgtatcgcccgaaacacccagctgttgctgcagcaggaatctggcacggtgcgtccagttgatccatgggcgggctcctattacgtggagtggttgaccaatgagctggctaaccgcgcgcgcaagcacatcgatgaggtggaggaagccggcggaatggcgcaggccaccgcgcagggaattcctaagctgcgcattgaggaatcagcggcacgcacccaggctcgcattgattccggccgccaggcgctgatcggcgtgaatcgctacgtggcggaagaagatgaggaaattgaagtcctcaaggttgacaacaccaaggttcgcgcagaacagttggctaaactcgcgcaactgaaagcagagcgcaacgatgcggaagtcaaggctgcgctggatgcgttgacagctgctgcccgcaacgagcataaagagccaggggatttggatcagaacctgctcaaacttgccgtcgatgctgcgcgcgcaaaagctaccattggagagatctccgatgctttggaagttgtctttggccgccacgaagcagaaatcaggacgctgtctggcgtgtacaaggatgaggttggaaaggaaggcacagtgagcaacgtcgaacgcgcgatcgccctggctgacgcctttgaggctgaggaaggccgccgcccacgtatctttattgccaagatgggccaggatggacatgaccgtggacagaaggttgtcgcgtctgcctatgctgacctgggcatggacgtggatgttggaccgctgtttcaaactccagccgaagctgcccgcgccgccgtggacgccgatgttcacgtggtgggtatgtcttcgctggcagcaggccacctcaccttgctgcccgagctgaagaaagaacttgcagctcttggccgcgatgacattctggtcaccgtgggcggcgtcattccgccgggcgatttccaggatctctacgatatgggtgccgccgcgatttacccttcaggaaccgtcatcgcggagtcggcgatcgatctgatcacccgactcgccgcacacctgggctttgacctggatgtggatgtgaatgaatgatcacggtttcctagaagaca

SEQ ID NO: 628 - protein, 737 aa, Corynebacterium glutamicum
MTSIPNFSDIPLTAETRASESHNVDAGKVWNTPEGIDVKRVFTQADRDEAQAAGHPVDSLPGQKPFMRGPYPTMYTNQPWTIRQYAGFSTAAESNAFYRRNLAAGQKGLSVAFDLATHRGYDSDNERVVGDVGMAGVAIDSILDMRQLFDGIDLSSVSVSMTMNGAVLPILAFYIVAAEEQGVGPEQLAGTIQNDILKEFMVRNTYIYPPKPSMRIISNIFEYTSLKMPRFNSISISGYHIQEAGATADLELAYTLADGIEYIRAGKEVGLDVDKFAPRLSFFWGISMYTFMEIAKLRAGRLLWSELVAKFDPKNAKSQSLRTHSQTSGWSLTAQDVYNNVARTAIEAMAATQGHTQSLHTNALDEALALPTDFSARIARNTQLLLQQESGTVRPVDPWAGSYYVEWLTNELANRARKHIDEVEEAGGMAQATAQGIPKLRIEESAARTQARIDSGRQALIGVNRYVAEEDEEIEVLKVDNTKVRAEQLAKLAQLKAERNDAEVKAALDALTAAARNEHKEPGDLDQNLLKLAVDAARAKATIGEISDALEVVFGRHEAEIRTLSGVYKDEVGKEGTVSNVERAIALADAFEAEEGRRPRIFIAKMGQDGHDRGQKVVASAYADLGMDVDVGPLFQTPAEAARAAVDADVHVVGMSSLAAGHLTLLPELKKELAALGRDDILVTVGGVIPPGDFQDLYDMGAAAIYPSGTVIAESAIDLITRLAAHLGFDLDVDVNE

SEQ ID NO: 629 - DNA, 2098 bp, Corynebacterium glutamicum
  CDS (101)..(2098): FRXA00148
ctttgagggcagcgcgcatgcgcccgatggttatttgaacatgacaattgatgccgcggcgacgctggctgacctgctagatgctttgggagcttaaatcatgacgtcgatccctaatttttcagacatcccattgactgctgagacacgtgcatcggagtcacacaacgttgacgccggcaaggtgtggaacactcccgaaggcattgatgtcaagcgcgtattcacgcaggctgaccgcgacgaggcgcaagcggcgggacatccggtggattctttgccaggtcaaaagccatttatgcgcgggccgtacccaactatgtacaccaatcagccgtggacgattcgccagtacgcaggcttttcaaccgccgcggaatccaatgcgttttatcggaggaaccttgctgcgggtcaaaaaggtttgtcggttgcgttcgatctagcgacccaccgcggttatgactcggataatgagcgcgtggtcggcgatgtgggtatggccggcgtggcgattgattcgattttggatatgcgtcagctgtttgatggcattgatttgtccagcgtgtcggtgtcgatgaccatgaatggcgctgtgctgccgattcttgcgttctatatcgtggcggctgaggaacaaggtgtgggtccggagcagcttgcgggcacgatccagaatgacatcttgaaagaatttatggtgcgcaacacctatatttatccgccgaagccgtcgatgcgcatcatttccaacatctttgagtacacctccttgaagatgccacgttttaactccatttcgatttctggctatcacatccaggaagcgggagcgactgccgatttggagctggcctacactctggcggatggtattgaatacatccgtgcaggtaaagaggtaggccttgacgtggataagttcgcgcctcgtctgtccttcttctggggtatttctatgtacaccttcatggagatcgcaaagctgcgtgcgggacgactgctgtggagcgagttggtggcaaaattcgatccgaaaaacgccaagtcccagtcgctgcgcacgcactcgcagacctctggttggtcgttgaccgcgcaggatgtgtacaacaacgtcgcccgcaccgcgattgaggcgatggctgcaacccagggccacacccagtcgctgcacaccaatgcacttgatgaggcgttggcgctgcccaccgatttctctgctcgtatcgcccgaaacacccagctgttgctgcagcaggaatctggcacggtgcgtccagttgatccatgggcgggctcctattacgtggagtggttgaccaatgagctggctaaccgcgcgcgcaagcacatcgatgaggtggaggaagccggcggaatggcgcaggccaccgcgcagggaattcctaagctgcgcattgaggaatcagcggcacgcacccaggctcgcattgattccggccgccaggcgctgatcggcgtgaatcgctacgtggcggaagaagatgaggaaattgaagtcctcaaggttgacaacaccaaggttcgcgcagaacagttggctaaactcgcgcaactgaaagcagagcgcaacgatgcggaagtcaaggctgcgctggatgcgttgacagctgctgcccgcaacgagcataaagagccaggggatttggatcagaacctgctcaaacttgccgtcgatgctgcgcgcgcaaaagctaccattggagagatctccgatgctttggaagttgtctttggccgccacgaagcagaaatcaggacgctgtctggcgtgtacaaggatgaggttggaaaggaaggcacagtgagcaacgtcgaacgcgcgatcgccctggctgacgcctttgaggctgaggaaggccgccgcccacgtatctttattgccaagatgggccaggatggacatgaccgtggacagaaggttgtcgcgtctgcctatgctgacctgggcatggacgtggatgttggaccgctgtttcaaactccagccgaagctgcccgcgccgccgtggacgccgatgttcacgtggtgggtatgtcttcgctggcagcaggccacctcaccttgctg

SEQ ID NO: 630 - protein, 666 aa, Corynebacterium glutamicum
MTSIPNFSDIPLTAETRASESHNVDAGKVWNTPEGIDVKRVFTQADRDEAQAAGHPVDSLPGQKPFMRGPYPTMYTNQPWTIRQYAGFSTAAESNAFYRRNLAAGQKGLSVAFDLATHRGYDSDNERVVGDVGMAGVAIDSILDMRQLFDGIDLSSVSVSMTMNGAVLPILAFYIVAAEEQGVGPEQLAGTIQNDILKEFMVRNTYIYPPKPSMRIISNIFEYTSLKMPRFNSISISGYHIQEAGATADLELAYTLADGIEYIRAGKEVGLDVDKFAPRLSFFWGISMYTFMEIAKLRAGRLLWSELVAKFDPKNAKSQSLRTHSQTSGWSLTAQDVYNNVARTAIEAMAATQGHTQSLHTNALDEALALPTDFSARIARNTQLLLQQESGTVRPVDPWAGSYYVEWLTNELANRARKHIDEVEEAGGMAQATAQGIPKLRIEESAARTQARIDSGRQALIGVNRYVAEEDEEIEVLKVDNTKVRAEQLAKLAQLKAERNDAEVKAALDALTAAARNEHKEPGDLDQNLLKLAVDAARAKATIGEISDALEVVFGRHEAEIRTLSGVYKDEVGKEGTVSNVERAIALADAFEAEEGRRPRIFIAKMGQDGHDRGQKVVASAYADLGMDVDVGPLFQTPAEAARAAVDADVHVVGMSSLAAGHLTLL

SEQ ID NO: 631 - DNA, 1971 bp, Corynebacterium glutamicum
  CDS (101)..(1948): RXA00149
ttttcgtaggtaaacacaggtgaaggctttacaagcttgtgaactccctacacaaaagcaatccaatagctatccataagcaagagaaagtaagtctacgttgactgatctcacaaagactgcggtgcccgaggaactttcagagaacctcgaaacttggtacaaggctgtggccggtgttttcgcgcgcacacagaaaaaagacatcggcgacattgccgtagatgtgtggaagaaactcatcgtcactacaccggatggtgttgatatcaatccgctgtacaccagagcagatgagtcccagaggaaattcactgaggttcctggtgagtttcccttcactaggggaaccactgttgatggtgaacgcgttggttggggtgttactgagactttcggacatgacagcccgaagaatatcaacgctgcggtgctgaatgctctgaattctggcaccaccacattgggttttgagttctctgaggaattcacggcagctgatcttaaagttgctctcgaaggcgtgtatctcaacatggctccgttgctgattcatgcgggtggatccacgtcagaggttgcagcggcgttgtatacgttggcggaggaagccggaacgttttttgctgcgttgaccttgggttctcgtcctttgacggcgcaggttgatggttcgcacagtgacaccattgaagaagcagttcagttggcagtgaatgcttccaagcgtgcgaatgtgcgcgctatcttggtggatggttccagtttttccaaccagggcgcgtcggatgctcaagaaattggtctaagtatcgccgccggtgtggattatgtccgtcgcttggtcgatgcaggcctttccacggaagctgcacttaagcaggtggcgttccgttttgcggtcaccgatgagcagttcgcgcagatttctaagctgcgtgtggctcgacgtctgtgggccagggtgtgtgaggtgcttggttttccagagctggccgtagcaccacagcatgcggtgactgcacgagcgatgtttagccagcgtgatccgtgggtgaatatgctgcgcagtactgttgcagctttcgctgcaggcgtcggtggagcaaccgatgtggaggttcgtacttttgatgatgcgatcccagatggagttcctggagtgtcgaggaatttcgctcaccgcatcgcgcgcaatactaatttgttgttgctagaagagtcacatcttggtcacgtggttgatcctgctggtggatcatatttcgtggagagcttcaccgatgatctagcggagaaggcgtgggctgtgttcagtggcatcgaagctgagggcggatacagtgcagcttgtgcatccggcacggtgactgccatgcttgatcagacgtgggagcagactcgcgctgatgtggcgtcgagaaagaagaagctcactggaattaatgagttcccgaacttggcggagtctccgctgccagctgatcgtcgggtagaacctgcaggtgtgcgtcgatgggcagcggattttgaagcgctgcgcaatcgttcggatgctttcttggaaaagaacggcgcgaggccacagatcacgatgattcctctgggaccgttgtccaagcacaatattcgcactggttttacttccaacctgttggcttccggtggcattgaagcaatcaacccgggtcaacttgttcccggcactgacgcttttgcagaagctgcacaggccgcaggcattgtagtggtgtgtggaacggaccaagagtatgccgaaacgggggagggagccgtcgaaaagctccgcgaagcgggcgttgagcgcatcctgcttgctggcgcgccgaagagctttgagggcagcgcgcatgcgcccgatggttatttgaacatgacaattgatgccgcggcgacgctggctgacctgctagatgctttgggagcttaaatcatgacgtcgatccctaa

SEQ ID NO: 632 - protein, 616 aa, Corynebacterium glutamicum
LTDLTKTAVPEELSENLETWYKAVAGVFARTQKKDIGDIAVDVWKKLIVTTPDGVDINPLYTRADESQRKFTEVPGEFPFTRGTTVDGERVGWGVTETFGHDSPKNINAAVLNALNSGTTTLGFEFSEEFTAADLKVALEGVYLNMAPLLIHAGGSTSEVAAALYTLAEEAGTFFAALTLGSRPLTAQVDGSHSDTIEEAVQLAVNASKRANVRAILVDGSSFSNQGASDAQEIGLSIAAGVDYVRRLVDAGLSTEAALKQVAFRFAVTDEQFAQISKLRVARRLWARVCEVLGFPELAVAPQHAVTARAMFSQRDPWVNMLRSTVAAFAAGVGGATDVEVRTFDDAIPDGVPGVSRNFAHRIARNTNLLLLEESHLGHVVDPAGGSYFVESFTDDLAEKAWAVFSGIEAEGGYSAACASGTVTAMLDQTWEQTRADVASRKKKLTGINEFPNLAESPLPADRRVEPAGVRRWAADFEALRNRSDAFLEKNGARPQITMIPLGPLSKHNIRTGFTSNLLASGGIEAINPGQLVPGTDAFAEAAQAAGIVVVCGTDQEYAETGEGAVEKLREAGVERILLAGAPKSFEGSAHAPDGYLNMTIDAAATLADLLDALGA

SEQ ID NO: 633 - DNA, 777 bp, Corynebacterium glutamicum
  CDS (101)..(754): RXN00317
caacggttacatcactcacgcattaactcccctggttggtaccgcatgttcgtttcccaagtctagccaagccttgaaaaattctggcaaggttaatggtgtgactacgccttctaagaaaactctgctctttgatctcgacggaaccctcgtcgattctttccccggtatccgcacttcattccttcacaccctgcacgaaaagaactgggaaatcccctctgaggaacgcatctcgcaagttccaggacctcccatggaatggacgttccaggatttgggcatgactccagagcaggcacaagacgctctgcagacctaccttgagcattacggccaggtgggttgggatctttccgaagcattccccggcatgcgagatttgctgatccgcttgaaatacgaaggtttccgtctgtgcaccgccacctccaagggcgagttctttgcggagaaggtacttcgcaaattcgagatgttcgatctcttcgaattcatgggtgccgccaccgacagcggcaaccgacgcagcaaatctgccgtgatcaaacatgtcctcgacagcgttgggttggacgaaccaaatgatattttgatgattggtgatcgatcacacgatattgaaggttcgagtgaattcggcatcgattgtgttgccgtaacctggggctacggcagcaaaactgaatgggacgctgcccgctacaccgtgagcaccgcagaagaattagaaaggatcatccatgactgggcctaaaacttcgctacctgtggaaa

SEQ ID NO: 634 - protein, 218 aa, Corynebacterium glutamicum
VTTPSKKTLLFDLDGTLVDSFPGIRTSFLHTLHEKNWEIPSEERISQVPGPPMEWTFQDLGMTPEQAQDALQTYLEHYGQVGWDLSEAFPGMRDLLIRLKYEGFRLCTATSKGEFFAEKVLRKFEMFDLFEFMGAATDSGNRRSKSAVIKHVLDSVGLDEPNDILMIGDRSHDIEGSSEFGIDCVAVTWGYGSKTEWDAARYTVSTAEELERIIHDWA

SEQ ID NO: 635 - DNA, 439 bp, Corynebacterium glutamicum
  CDS (101)..(439): FRXA00317
caacggttacatcactcacgcattacctcccctggttggtaccgcatgttcgtttcccaagtcaagccaagccttgaaaaattctggcaaggttaatggtgtgactacgccttctaagaaaactctgctctttgatctcgacggaaccctcgtcgattctttccccggtatccgcacttcattccttcacaccctgcacgaaaagaactgggaaatcccctctgaggaacgcatctcgcaagttccaggacctcccatggaatggacgttccaggatttgggcatgactccagagcaggcacaagacgctctgcagacctaccttgagcattacggccaggtgggttgggatctttccgaagcattccccggcatgcgagatttgctgatccccttgatatacgaaggttttcgtctgtgcaccgccacctttcaaggg

SEQ ID NO: 636 - protein, 113 aa, Corynebacterium glutamicum
VTTPSKKTLLFDLDGTLVDSFPGIRTSFLHTLHEKNWEIPSEERISQVPGPPMEWTFQDLGMTPEQAQDALQTYLEHYGQVGWDLSEAFPGMRDLLIPLIYEGFRLCTATFQG

SEQ ID NO: 637 - DNA, 816 bp, Corynebacterium glutamicum
  CDS (101)..(793): RXA02196
tctaccacccagaggcaaagtactttaacgtctaacacctttgagagggaaaactttcccgcacattgcagatcgtgccactttaactaaggttgacggcatgattaaggcgattttctgggacatggacggcacgatggtggactctgagccacagtggggcattgctacctacgagctcagcgaagccatgggccgccgcctcaccccggagctccgggaactcaccgtcggctcgagcctgccgcgcaccatgcgcttatgcgcagagcacgcaggcattacattgagcgacgcggactacgagcgctaccgggctggcatgttcgcccgggtccatgagcttttcgacgaatccctcgtcccaaatccaggcgtcaccgaactcctgacagagttgaaggccctcgagatccccatgttggtcaccaccaacacagagcgcgatctcgcgacccgttcagtcgcagccgtgggaaatgagttcttcatcggttctatcgctggtgatgaagtcccaacagcaaagccagcccccgacatgtacctcgaagcagcacgacgtgtgggctttgacccatcagagtgcctcgtgttcgaagattcctacaacggcatgctgggcgctgttactgcaggttgccgcgtcattggtctgcacccagaagaagtccaagcgccagaaggtgtagtgcctttgcgttccctccacggtaaaaactctttcgaaggtgtcaccgctgagatggtcactgcctggtaccaccagatcgagccggcaggtgtcgcaaaataaaaccaggtgggggagtgaaa

SEQ ID NO: 638 - protein, 231 aa, Corynebacterium glutamicum
MIKAIFWDMDGTMVDSEPQWGIATYELSEAMGRRLTPELRELTVGSSLPRTMRLCAEHAGITLSDADYERYRAGMFARVHELFDESLVPNPGVTELLTELKALEIPMLVTTNTERDLATRSVAAVGNEFFIGSIAGDEVPTAKPAPDMYLEAARRVGFDPSECLVFEDSYNGMLGAVTAGCRVIGLHPEEVQAPEGVVPLRSLHGKNSFEGVTAEMVTAWYHQIEPAGVAK

SEQ ID NO: 639 - DNA, 531 bp, Corynebacterium glutamicum
  CDS (101)..(508): RXN02461
agaaaatctcaaggcaaaaaacaagccaccccaatctgtgcgacaatcaaaccacagactacgactattatgtcacgaagaaaccaaagaaagggaaataatgcgcggactaattgttgactacgctggagtactagacggaaccgatgaggaccagcgtcgctggcgcaacctgctcgccgcagcaaagaaaaatggcgtcggaaccgtgatcctcagcaacgatccaggtgggctcggcgcagcgccgatccgggaactcgaaacaaacggggtagtcgataaggtgctgctgtcgggagaacttggcgtcgaaaagccagaggaagcagctttccaggccgccgcagacgccatcgacctgcccatgcgtgactgcgtgcttgtcgacgactcgatcctcaacgtgcgcggcgccgtcgaagccggactcgtaggcgtctactaccagcaatttgaccgtgcagtcgtcgaaatcgtcggactgttcgggctagaaggagaattctaatcttgcgcgtctacatccca

SEQ ID NO: 640 - protein, 136 aa, Corynebacterium glutamicum
MRGLIVDYAGVLDGTDEDQRRWRNLLAAAKKNGVGTVILSNDPGGLGAAPIRELETNGVVDKVLLSGELGVEKPEEAAFQAAADAIDLPMRDCVLVDDSILNVRGAVEAGLVGVYYQQFDRAVVEIVGLFGLEGEF

SEQ ID NO: 641 - DNA, 1662 bp, Corynebacterium glutamicum
  CDS (101)..(1639): RXN01744
tcttattggttcttcgttttgtatcgataaatacaatcggtttcctggcttaataaggctgttcctgtcaacctgcaatggaagaggaagtgtacctagcgtggatgtcgtcgacatcgcacggtggcaattcggaattaccaccgtctatcacttcatttttgtcccactgaccattggcttagcgccgctggtcgcaatcatgcaaacgttttggcaagttaccggcaaagagcactggtatcgggccacaagattttttggcactgtgctgctcatcaacttcgcggttggtgtagcaacgggcattgtgcaggagttccagttcggtatgaactggtcggaatattcgcgtttcgtcggtgatgttttcggcggaccgctggctttggagggtcttatcgcgttcttccttgagtctgtattcctgggactgtggattttcggatgggggaagattcctggttggttgcacactgcatccatttggatcgttgctattgcgacgaatatttctgcctatttcatcatcgtggccaactcgtttatgcagcatccggtgggtgctgagtataaccctgagactggtcgtgcggagcttactgatttttgggctcttctcacaaactccaccgcgctggctgcgttcccgcatgctgttgccggtggttttttaacagctggaactttcgttctcggaatttcgggttggtggattattcgtgcgcaccgtcaggccaagaaggctgagtcggaaatcgagtcgaagcattcgatgcacaggcccgcgttgtgggttggttggtggaccacagttgtctcttccgtggcgctgttcatcactggcgatatccaggcgaagctcatgttcgtgcaacagccaatgaagatggcgtcggcggaatccttgtgtgaaaccgccacagatccaaacttctccattctgacaattggtacgcacaacaactgcgatacggtaacccacctgatcgatgttccgtttgtgcttccattcttggctgaaggaaaattcaccggtgtgactttgcagggtgtaaaccagctccaagctgcagcggagcaagcatacggtcctggcaactactcccctaacttgtttgtcacctactggtcattccgcgcaatgatcggcctgatgcttggttctttggctatcgctgcgattgcgtggctgttgctgcgtaagaagcgcacaccaactggaaagattgctcgtctgttccagatcggcagcctcattgctatcccgttcccattcttggccaactctgctggttggatcttcaccgagatgggccgccagccttgggtggtgcacccgaaccctgaatctgccggcgatgcccgaacagagatgatccggatgactgttgatatgggtgtatctgatcatgcgccatggcaagtctggctgactctcattggcttcacgattctctatctcattttgttcgtggtgtgggtgtggctgattcgccgcgcagttctgatcggaccaccagaggaaggcgctccatccgtggaggcaaagactggaccggcaaccccgattggttcagatatgcccatgacaccgctgcaatttactgccgctgccccaaccacaggtgaaaaggaataaccatggatctcaataccttt

SEQ ID NO: 642 - protein, 513 aa, Corynebacterium glutamicum
VDVVDIARWQFGITTVYHFIFVPLTIGLAPLVAIMQTFWQVTGKEHWYRATRFFGTVLLINFAVGVATGIVQEFQFGMNWSEYSRFVGDVFGGPLALEGLIAFFLESVFLGLWIFGWGKIPGWLHTASIWIVAIATNISAYFIIVANSFMQHPVGAEYNPETGRAELTDFWALLTNSTALAAFPHAVAGGFLTAGTFVLGISGWWIIRAHRQAKKAESEIESKHSMHRPALWVGWWTTVVSSVALFITGDIQAKLMFVQQPMKMASAESLCETATDPNFSILTIGTHNNCDTVTHLIDVPFVLPFLAEGKFTGVTLQGVNQLQAAAEQAYGPGNYSPNLFVTYWSFRAMIGLMLGSLAIAAIAWLLLRKKRTPTGKIARLFQIGSLIAIPFPFLANSAGWIFTEMGRQPWVVHPNPESAGDARTEMIRMTVDMGVSDHAPWQVWLTLIGFTILYLILFVVWVWLIRRAVLIGPPEEGAPSVEAKTGPATPIGSDMPMTPLQFTAAAPTTGEKE

SEQ ID NO: 643 - DNA, 238 bp, Corynebacterium glutamicum
  CDS (101)..(238): FRXA00055
tcttattggttcttcgttttgtatcgataaatacaatcggtttcctggcttaataaggctgttcctgtcaacctgcaatggaagaggaagtgtacctagcgtggatgtcgtcgacatcgcacggtggcaattcggaattaccaccgtctatcacttcatttttgtcccactgaccattggcttagcaccgctggtcgcgatcatgcaaacgttttggcaagttaccggcaaagagcac

SEQ ID NO: 644 - protein, 46 aa, Corynebacterium glutamicum
VDVVDIARWQFGITTVYHFIFVPLTIGLAPLVAIMQTFWQVTGKEH

SEQ ID NO: 645 - DNA, 1325 bp, Corynebacterium glutamicum
  CDS (1)..(1302): FRXA01744
tggtcggaatattcgcgtttcgtcggtgatgttttcggcggaccgctggctttggagggtcttatcgcgttcttccttgagtctgtattcctgggactgtggattttcggatgggggaagattcctggttggttgcacactgcatccatttggatcgttgctattgcgacgaatatttctgcctatttcatcatcgtggccaactcgtttatgcagcatccggtgggtgctgagtataaccctgagactggtcgtgcggagcttactgatttttgggctcttctcacaaactccaccgcgctggctgcgttcccgcatgctgttgccggtggttttttaacagctggaactttcgttctcggaatttcgggttggtggattattcgtgcgcaccgtcaggccaagaaggctgagtcggaaatcgagtcgaagcattcgatgcacaggcccgcgttgtgggttggttggtggaccacagttgtctcttccgtggcgctgttcatcactggcgatatccaggcgaagctcatgttcgtgcaacagccaatgaagatggcgtcggcggaatccttgtgtgaaaccgccacagatccaaacttctccattctgacaattggtacgcacaacaactgcgatacggtaacccacctgatcgatgttccgtttgtgcttccattcttggctgaaggaaaattcaccggtgtgactttgcagggtgtaaaccagctccaagctgcagcggagcaagcatacggtcctggcaactactcccctaacttgtttgtcacctactggtcattccgcgcaatgatcggcctgatgcttggttctttggctatcgctgcgattgcgtggctgttgctgcgtaagaagcgcacaccaactggaaagattgctcgtctgttccagatcggcagcctcattgctatcccgttcccattcttggccaactctgctggttggatcttcaccgagatgggccgccagccttgggtggtgcacccgaaccctgaatctgccggcgatgcccgaacagagatgatccggatgactgttgatatgggtgtatctgatcatgcgccatggcaagtctggctgactctcattggcttcacgattctctatctcattttgttcgtggtgtgggtgtggctgattcgccgcgcagttctgatcggaccaccagaggaaggcgctccatccgtggaggcaaagactggaccggcaaccccgattggttcagatatgcccatgacaccgctgcaatttactgccgctgccccaaccacaggtgaaaaggaataaccatggatctcaataccttt

SEQ ID NO: 646 - protein, 434 aa, Corynebacterium glutamicum
WSEYSRFVGDVFGGPLALEGLIAFFLESVFLGLWIFGWGKIPGWLHTASIWIVAIATNISAYFIIVANSFMQHPVGAEYNPETGRAELTDFWALLTNSTALAAFPHAVAGGFLTAGTFVLGISGWWIIRAHRQAKKAESEIESKHSMHRPALWVGWWTTVVSSVALFITGDIQAKLMFVQQPMKMASAESLCETATDPNFSILTIGTHNNCDTVTHLIDVPFVLPFLAEGKFTGVTLQGVNQLQAAAEQAYGPGNYSPNLFVTYWSFRAMIGLMLGSLAIAAIAWLLLRKKRTPTGKIARLFQIGSLIAIPFPFLANSAGWIFTEMGRQPWVVHPNPESAGDARTEMIRMTVDMGVSDHAPWQVWLTLIGFTILYLILFVVWVWLIRRAVLIGPPEEGAPSVEAKTGPATPIGSDMPMTPLQFTAAAPTTGEKE

SEQ ID NO: 647 - DNA, 307 bp, Corynebacterium glutamicum
  CDS (101)..(307): RXA00379
cgtgctggataaacagcaccgccccgcagcagtgttcttgcgcgaagtcacctccaaagatgtgttggatgttgcgttgccattggtagatgaggcctaaatgtctgagattgtggtagcccaaagcatcggccagcagtttgctgacgtcgcagcttccgggccactgttccttggcatccttgccgcagcgctcgcaggtctggtgtcttttgccagcccgtgtgttgtgccgttggtgccaggatatatttcctacctcgccggcgtggtcggtggggaagtggaatacagcgctcatgccacc

SEQ ID NO: 648 - protein, 69 aa, Corynebacterium glutamicum
MSEIVVAQSIGQQFADVAASGPLFLGILAAALAGLVSFASPCVVPLVPGYISYLAGVVGGEVEYSAHAT

SEQ ID NO: 649 - DNA, 362 bp, Corynebacterium glutamicum
  CDS (1)..(339): RXA00385
cttggcggagtgttcgctctcggttggaccccttgtttgggccccaccctggctgcgatcatctccatttctgcaggtactgaaggcatgaccgctgcgcgtggcgtgatcttaattgtgggttactgcctcggactggggctgccgttcctgctgatcgcgttgggctccagcaaggcactcaccggagtcgagtggttgcgcaagcattcccgcaccctgcaaattatcggcggtgtgtttttgatcttggtcggagtagcgttgctctctggctcatgggcaatttttatcaactgggtccgtcagtggaccgttgaatacggcgcaacactgctctagaaaaagacttttagtaggaa

SEQ ID NO: 650 - protein, 113 aa, Corynebacterium glutamicum
LGGVFALGWTPCLGPTLAAIISISAGTEGMTAARGVILIVGYCLGLGLPFLLIALGSSKALTGVEWLRKHSRTLQIIGGVFLILVGVALLSGSWAIFINWVRQWTVEYGATLL

SEQ ID NO: 651 - DNA, 901 bp, Corynebacterium glutamicum
  CDS (101)..(901): RXA01743
aggcaaagactggaccggcaaccccgattggttcagatatgcccatgacaccgctgcaatttactgccgctgccccaaccacaggtgaaaaggaataaccatggatctcaataccttttggtttattctcatcgcatttttgtttgcgggatactttctcctcgaaggattcgacttcggcgtcggaattttggcacccatcatcggtaaagattcagcggctaggaacacagtgatccgtacgattggccctgtctgggacggaaatgaagtgtggctgatcgtggcaggtggcgctttgtttgctgccttccctgagtggtacgcaacgatgttctccggaatgtatctgccgctgttcctcgtgcttgtgtcgttgatcatgcgcgtggtgggccttgaatggcgcaagaaagtcgatgatcctcgttggcaaaagtggtctgaccgggccatctttattggttcttggactccaccgctgatgtggggattcatcttcgccaatattttgcgtggcatgcccctcaaggcggatcacaccatcgatgctgcggcagcccttcctggcatggtcaacgtcttcgccattctgggtgcacttgcgttcaccgcactgttcgcccttcatggtctcgcattcatccgcctgaaaactgctggtcgggtgcgcaccgatgcggcgaaggcagctccagtagtcgcacttcttgctgcggtgactggtggacctttcgtgttgtgggctgccatcgcatacggccgttcctggtcctggatcctcgcagtgctgatcatcgcagcggttctcggtggagctttcgcactgatcaaagaccgcgatggattaagcttcctgtccacttccgtcgctgtcatcggtgtcgttgcactgctgttt

SEQ ID NO: 652 - protein, 267 aa, Corynebacterium glutamicum
MDLNTFWFILIAFLFAGYFLLEGFDFGVGILAPIIGKDSAARNTVIRTIGPVWDGNEVWLIVAGGALFAAFPEWYATMFSGMYLPLFLVLVSLIMRVVGLEWRKKVDDPRWQKWSDRAIFIGSWTPPLMWGFIFANILRGMPLKADHTIDAAAALPGMVNVFAILGALAFTALFALHGLAFIRLKTAGRVRTDAAKAAPVVALLAAVTGGPFVLWAAIAYGRSWSWILAVLIIAAVLGGAFALIKDRDGLSFLSTSVAVIGVVALLF

SEQ ID NO: 653 - DNA, 1779 bp, Corynebacterium glutamicum
  CDS (101)..(1756): RXN02480
acctatgaccgctgtggcgcctagggtcgacgggcacgtcgcccctcagaggcccgagccgacaggccatgcacgcaagggcagcaaagcatggttaatgatgaccaccaccgaccacaagcagctgggcattatgtacatcattatgtccttcagcttcttcttcctcggtggcttgatggccctgcttatccgagcggagcttttcacccctggtctgcagttcctgtctaatgagcagttcaaccagctgttcaccatgcacggaactgtcatgctgctgctgtacggaactccaattgtttggggttttgctaactacgtcctgccacttcagatcggtgcgcctgacgtagctttcccacgtttgaatgctttcggcttctggatcaccaccgtcggtggtgtcgcgatgctgaccggcttcctgaccccgggtggtgctgccgacttcggttggaccatgtactccccactgtctgacgcaattcactccccaggccttggctctgacatgtggattgtcggtgtcggtgcaactggtattggctccgttgcttccgcaattaacatgctcaccaccatcctctgcctccgcgcacctggtatgaccatgttccgtatgcctattttcacctggaatatcttcgttgtttccgttcttgctctgctgatcttcccactgctgctcgctgctgcactgggtgttctgtatgaccgcaagcttggtggacacctgtacgatccagctaacggcggctccctcctgtggcagcacctgttctggttcttcggacaccctgaggtttacgttctggcgctgccgttcttcggcattgtttctgagatcattcctgtgttctcccgtaagccaatgttcggttacgtcggcctgatcttcgcaaccttgtccattggtgcactgtccatggctgtgtgggctcaccacatgttcgttactggcgcagttttgcttccgttcttctccttcatgacgttcctgatttcggttcctaccggcgttaagttcttcaactgggttggaaccatgtggaagggtcacatcacttgggaaaccccaatgatctggtctgttggcttcatggctaccttcctcttcggtggtctgaccggcattatgctggcgtccccaccactggacttccacttggctgactcctacttcctgatcgcgcacttccactacaccctcttcggtaccgtggtgttcgcatcgtgtgcaggcgtttacttctggttcccgaagatgactggccgcatgatggacgagcgtcttggcaagatccacttctggttgaccttcgtcggtttccacggaaccttcctcatccagcactgggtgggcaacatgggtatgccacgtcgttacgctgactacctggattctgatggtttcaccatctacaaccagatctccaccgtgttctacttcctgcttggcctgtctgtcattccattcatctggaacgtcttcaagtcctggcgctacggtgagctcgttaccgttgatgatccttggggttacggcaactccctggagtgggcaacctcctgccctcctcctcgccacaacttcgcatccttgcctcgtatccgctccgagcgccctgcgttcgagctgcactacccgcacatgattgaacgcatgcgcgcagaggcacacactggacatcacgatgatattaatgctccagaattgggtaccgccccagcccttgcatctgactccagccgctaaaagcgtctgatttaagtcgg

SEQ ID NO: 654 - protein, 552 aa, Corynebacterium glutamicum
MTTTDHKQLGIMYIIMSFSFFFLGGLMALLIRAELFTPGLQFLSNEQFNQLFTMHGTVMLLLYGTPIVWGFANYVLPLQIGAPDVAFPRLNAFGFWITTVGGVAMLTGFLTPGGAADFGWTMYSPLSDAIHSPGLGSDMWIVGVGATGIGSVASAINMLTTILCLRAPGMTMFRMPIFTWNIFVVSVLALLIFPLLLAAALGVLYDRKLGGHLYDPANGGSLLWQHLFWFFGHPEVYVLALPFFGIVSEIIPVFSRKPMFGYVGLIFATLSIGALSMAVWAHHMFVTGAVLLPFFSFMTFLISVPTGVKFFNWVGTMWKGHITWETPMIWSVGFMATFLFGGLTGIMLASPPLDFHLADSYFLIAHFHYTLFGTVVFASCAGVYFWFPKMTGRMMDERLGKIHFWLTFVGFHGTFLIQHWVGNMGMPRRYADYLDSDGFTIYNQISTVFYFLLGLSVIPFIWNVFKSWRYGELVTVDDPWGYGNSLEWATSCPPPRHNFASLPRIRSERPAFELHYPHMIERMRAEAHTGHHDDINAPELGTAPALASDSSR

SEQ ID NO: 655 - DNA, 385 bp, Corynebacterium glutamicum
  CDS (101)..(385): FRXA01919
  misc_feature 345: n = a,c,g,or t
  VARIANT 82: Xaa = any amino acid
acctatgaccgctgtggcgcctagggtcgacgggcacgtcgcccctcagaggcccgagccgacaggccatgcacgcaagggcagcaaagcatggttaatgatgaccaccaccgaccacaagcagctgggcattatgtacatcattatgtccttcagcttctttttcctcggtggcttgatggccctgcttatccgagcggagcttttcacccctggtctgcagttcctgtctaatgagcagttcaaccagctgttcaccatgcacggaactgtcatgctgctgctgtacggaactccaattgtttggggttttgctaactacgtcctgccacttccaaccaccangcaagccttctctaaaacccgggtgaactctcccagggag

SEQ ID NO: 656 - protein, 95 aa, Corynebacterium glutamicum
  VARIANT 82: Xaa = any amino acid
MTTTDHKQLGIMYIIMSFSFFFLGGLMALLIRAELFTPGLQFLSNEQFNQLFTMHGTVMLLLYGTPIVWGFANYVLPLPTTXQAFSKTRVNSPRE

SEQ ID NO: 657 - DNA, 972 bp, Corynebacterium glutamicum
  CDS (101)..(949): FRXA02480
tacgttctggcgctgccgttcttcggcattgtttctgagatcattcctgtgttctcccgtaagccaatgttcgggttacgtcggcctgatcttcgcaaccttgtccattggtgcactgtccatggctgtgtgggctcaccacatgttcgttactggcgcagttttgcttccgttcttctccttcatgacgttcctgatttcggttcctaccggcgttaagttcttcaactgggttggaaccatgtggaagggtcacatcacttgggaaaccccaatgatctggtctgttggcttcatggctaccttcctcttcggtggtctgaccggcattatgctggcgtccccaccactggacttccacttggctgactcctacttcctgatcgcgcacttccactacaccctcttcggtaccgtggtgttcgcatcgtgtgcaggcgtttacttctggttcccgaagatgactggccgcatgatggacgagcgtcttggcaagatccacttctggttgaccttcgtcggtttccacggaaccttcctcatccagcactgggtgggcaacatgggtatgccacgtcgttacgctgactacctggattctgatggtttcaccatctacaaccagatctccaccgtgttctacttcctgcttggcctgtctgtcattccattcatctggaacgtcttcaagtcctggcgctacggtgagctcgttaccgttgatgatccttggggttacggcaactccctggagtgggcaacctcctgccctcctcctcgccacaacttcgcatccttgcctcgtatccgctccgagcgccctgcgttcgagctgcactacccgcacatgattgaacgcatgcgcgcagaggcacacactggacatcacgatgatattaatgctccagaattgggtaccgccccagcccttgcatctgactccagccgctaaaagcgtctgatttaagtcgg

SEQ ID NO: 658 - protein, 283 aa, Corynebacterium glutamicum
LSIGALSMAVWAHHMFVTGAVLLPFFSFMTFLISVPTGVKFFNWVGTMWKGHITWETPMIWSVGFMATFLFGGLTGIMLASPPLDFHLADSYFLIAHFHYTLFGTVVFASCAGVYFWFPKMTGRMMDERLGKIHFWLTFVGFHGTFLIQHWVGNMGMPRRYADYLDSDGFTIYNQISTVFYFLLGLSVIPFIWNVFKSWRYGELVTVDDPWGYGNSLEWATSCPPPRHNFASLPRIRSERPAFELHYPHMIERMRAEAHTGHHDDINAPELGTAPALASDSSR

SEQ ID NO: 659 - DNA, 735 bp, Corynebacterium glutamicum
  CDS (101)..(712): FRXA02481
tgctaactacgtcctgccacttcagatcggtgcgcctgacgtagctttcccacgttgaaatgctttcggcttctgaatcaccaccgtcggtggtgtcgcgatgctgaccggcttcctaaccccgggtggtgctgccgacttgggtggaccatgtactccccactgtctgacgcaattcactccccaggccttggttctaacatgtggattgtcgggtgtcggtgcaactggtattggctccgttgcttccgcaattaacatgctcaccaccatcctctgcctccgcgcacctggtatgaccatgttccgtatgcctattttcacctggaatatcttcgttgtttccgttcttgctctgctgatcttcccactgctgctcgctgctgcactgggtgttctgtatgaccgcaagcttggtggacacctgtacgatccagctaacggcggctccctcctgtggcagcacctgttctggttcttcggacaccctgaggtttacgttctggcgctgccgttcttcggcattgtttctgagatcattcctgtgttctcccgtaagccaatgttcgggttacgtcggcctgatcttcgcaaccttgtccattggtgcactgtccatggctgtgtgggctcaccacatgttcgttactggcgcagttttgcttccgttcttctccttcatgacgttcctgatttcggttcctaccggcgttaagttcttcaactgggttggaa

SEQ ID NO: 660 - protein, 204 aa, Corynebacterium glutamicum
MLTGFLTPGGAADLGGPCTPHCLTQFTPQALVLTCGLSGVGATGIGSVASAINMLTTILCLRAPGMTMFRMPIFTWNIFVVSVLALLIFPLLLAAALGVLYDRKLGGHLYDPANGGSLLWQHLFWFFGHPEVYVLALPFFGIVSEIIPVFSRKPMFGLRRPDLRNLVHWCTVHGCVGSPHVRYWRSFASVLLLHDVPDFGSYRR

SEQ ID NO: 661 - DNA, 1200 bp, Corynebacterium glutamicum
  CDS (101)..(1177): RXA02140
aacacaagatatggaatcggctggcaaataggctattctgcgaagatagaaatgaccgtaaggtctctggtttttgtgtggacaggaaggcagaacacacgtggaacagcaaaataagcgtggtttaaagcgcaaggccctgcttggcggtgtcttgggcttaggtggcctcgccatggcaggctgtgaagtcgcccctcctggcggtgtgcttggagatttcctacgtatgggttggcctgatggcattacccctgaagcagtggccatgggtaacttctggtcatgggtctgggttgctgcctggatcatcggcatcatcatgtggggtctattcctcaccgccatctttgcctggggcgcaaagagggctgaaaagcgcggcgagggtgaattccctaagcagctccagtacaacgttccacttgagctcgttctgacgatcgttccgatcatcattgttatggtgctgttcttcttcaccgttcaaactcaggacaaggtcaccgctctggataagaacccagaggttaccgtggacgtcaccgcttaccagtggaactggaagttcggatactccgaaattgatggctcactggcacctggtggacaggattaccaaggaagcgacccggagcgtcaggcagctgccgaggcttccaagaaggatccttctggagataacccaattcacggcaactcaaagtctgacgtttcttaccttgagttcaaccgaattgaaaccctcggaaccactgatgaaatcccagtgatggttcttcctgtgaacaccccaatcgagttcaacctcgcatctgctgacgttgcacactccttctgggttccagagttcctcttcaagcgagatgcttacgcacaccctgaggcaaacaagtcccagcgtgtcttccagattgaagagatcactgaggaaggcgcattcgttggtcgctgtgcagaaatgtgcggtacttaccacgcaatgatgaacttcgagcttcgtgtcgtcgatcgcgattccttcgctgagtacatcagcttccgtgactccaacccagacgcaaccaacgctcaggcacttgagcacattggtcaagctccttacgctacttccactagcccattcgtttccgatcgcaccgcaacccgcgacggcgaaaacactcagagcaacgcttaagaaggagtggcgaaaaaatg

SEQ ID NO: 662 - protein, 359 aa, Corynebacterium glutamicum
VEQQNKRGLKRKALLGGVLGLGGLAMAGCEVAPPGGVLGDFLRMGWPDGITPEAVAMGNFWSWVWVAAWIIGIIMWGLFLTAIFAWGAKRAEKRGEGEFPKQLQYNVPLELVLTIVPIIIVMVLFFFTVQTQDKVTALDKNPEVTVDVTAYQWNWKFGYSEIDGSLAPGGQDYQGSDPERQAAAEASKKDPSGDNPIHGNSKSDVSYLEFNRIETLGTTDEIPVMVLPVNTPIEFNLASADVAHSFWVPEFLFKRDAYAHPEANKSQRVFQIEEITEEGAFVGRCAEMCGTYHAMMNFELRVVDRDSFAEYISFRDSNPDATNAQALEHIGQAPYATSTSPFVSDRTATRDGENTQSNA

SEQ ID NO: 663 - DNA, 774 bp, Corynebacterium glutamicum
  CDS (101)..(751): RXA02142
acgaaaagttcccggaaggtcgattgaaaagtttgcgaattgggggaaaattcgcatcaaaagccgagttcaaactttcaattgaaacggggggcttgaagtgactttggccaaccaaacagccatactagatagcgtgacgagcgcagttggaaatacaggtatggcagcaccacaacgtgttgcggcactgaaccgtccgaatatggtcagtgtcggcaccattgtgttcctgtctcaggaattaatgttcttcgccgggctattcgcgatgtacttcgtgtcccgtgcgaacggactggcaaatggatcatggggagagcagacagatcacctcaacgtgccctacgcactgttgattacggtcattctggtgtcttcctcagtgacttgccagttcggagtttttgcggctgaaaggggtgacgtttacggcctccgcaagtggttcttggtcacgattatcctcggatcaatcttcgtgatcggacagggctacgagtacatcactctcgtaggtcacggacttacaatccagagcagtgtctacggatcggcattctttattacaaccggtttccacgcactgcacgtgatcgcgggtgttatggccttcgttgtggttcttatgagaatccataagtcgaagttcactccggcacaggcaaccgcagcaatggttgtgtcttattactggcacttcgttgacgtggtctggatcggcctcttcatcactatttacttcattcagtaggcagtaaggaatcctcaacg

SEQ ID NO: 664 - protein, 217 aa, Corynebacterium glutamicum
VTLANQTAILDSVTSAVGNTGMAAPQRVAALNRPNMVSVGTIVFLSQELMFFAGLFAMYFVSRANGLANGSWGEQTDHLNVPYALLITVILVSSSVTCQFGVFAAERGDVYGLRKWFLVTIILGSIFVIGQGYEYITLVGHGLTIQSSVYGSAFFITTGFHALHVIAGVMAFVVVLMRIHKSKFTPAQATAAMVVSYYWHFVDVVWIGLFITIYFIQ

SEQ ID NO: 665 - DNA, 1347 bp, Corynebacterium glutamicum
  CDS (101)..(1324): RXA02144
actcactcggtagcttgggcccagtggctgagggtctgttcatgtgggtattcggcatcttggtcctcgtggccgccgctatgtggattggatcacgttcatgagtaacaacaacgacaaacagtacacaacccaagaactcaacgcgatgagcaatgaggatcttgcacgacttggtacagagctggacgacgttaccattgcataccgcaaggaacgtttcccaatcgctaatgacccagctgagaagcgcgctgcacgtgcagttactttctggctagtcctcggcatcattggtggacttgggttcctggctacctacattttctggccttgggagtacaaggcacacggagatgaaggtctcctggcgtacaccttgtacaccccaatgctgggtattacttccggtctttgcatcctgtccctgggatttgcagttgtcctttatgtcaagaagttcattccagaggaaatcgcagtacagcgtcgccacgacggtccttctgaagaagttgaccgccgcaccatcgttgcacttctcaatgactcttggcagacctctactcttggtcgtcgcaagctgatcatgggacttgcaggtggcggagcagtactggccggcctgaccatcatcgctccaatgggcggtatgatcaagaacccttggaatcctaaggaaggcccaatggacgttcagggtgacggcaccctgtggacttccggttggactctcgttgagaacgacgtcaaggtttacctcggccgcgacactgcagcaattgcggagtcccacaccgatgcaaccggtgagcactggtcaaccactggtgtttcccgcctggttcgtatgcgcccagaagatctggcagcagcatccatggaaactgtcttcccacttccagctgaaatggtgaacgacggtgctgaatacgatcctgcgaaggacgtctacgagcaccaaatgcactcggtgcacggcccacgcaacgcagttatgttgatccgtctccgtaccgctgacgctgaaaaggttatcgaacgcgaaggccaggagtccttccactacggtgactactacgcttactccaagatttgtacacacattggttgcccaacctcactgtacgaggctcagaccaatcgtattctgtgcccatgtcaccagtcgcagtttgacgcattgcactacggaaagccagtctttggacctgctgcccgtgcactgccacagctgccaattaccgttgatgaagagggctacctcatcgccgctggtaacttcattgagccactcggccctgcattctgggagcgtaagtcatgagtctagctaccgtgggaaac

SEQ ID NO: 666 - protein, 408 aa, Corynebacterium glutamicum
MSNNNDKQYTTQELNAMSNEDLARLGTELDDVTIAYRKERFPIANDPAEKRAARAVTFWLVLGIIGGLGFLATYIFWPWEYKAHGDEGLLAYTLYTPMLGITSGLCILSLGFAVVLYVKKFIPEEIAVQRRHDGPSEEVDRRTIVALLNDSWQTSTLGRRKLIMGLAGGGAVLAGLTIIAPMGGMIKNPWNPKEGPMDVQGDGTLWTSGWTLVENDVKVYLGRDTAAIAESHTDATGEHWSTTGVSRLVRMRPEDLAAASMETVFPLPAEMVNDGAEYDPAKDVYEHQMHSVHGPRNAVMLIRLRTADAEKVIEREGQESFHYGDYYAYSKICTHIGCPTSLYEAQTNRILCPCHQSQFDALHYGKPVFGPAARALPQLPITVDEEGYLIAAGNFIEPLGPAFWERKS

SEQ ID NO: 667 - DNA, 1053 bp, Corynebacterium glutamicum
  CDS (101)..(1030): RXA02740
aacgcaaggtgcacactcaccgcagggatatttaaataataaggactcacaacttaaatatatgagtgatttgaaaatgcaacgttctggaggagaacccttggacacgatcaaggcctatattgcgctaacgaagcccagggttattgaactcctccttgtcgccacaatccccacaatgcttcaggctgaacgcggtgagaacaacattgtgctcatcttgctgactgtgttcggtggctggatgggtgcggccgccgccaacaccttcaacatggtggcagactccgatattgatcagcgcatgggacgcactagggctcgccctttggtgcgccacaccgtgagtaatcgcgacgcctccatttttgcgtgggtcctgacagtggccagcttcttgtggctgtggctgctgtgcgattcgatgctcgccggcatcttcgtgttgatcacgattttcttctacatttttgtctacaccaagtggctgaagcgccgcacgcacatgaatatcgtgtggggcggagccgcaggttgtatgccagtgctcgtcggctgggcagtgatcgttgatcagtttgagccaggcgttccacagcagtggtggcaggcaattgtcctgttcatggtgattttcttctggaccccacctcacacctgggctctggccatgaagtaccgcgaagactacaaggcggctggcgtcccaatgcttcctgtcgtgcgcaccccagtccaggtcaccgcacaaatcgtgtggtactccgtggcaactgtgctgaccaccttcttgctcatcccagcaactggttggatctacgcagcgatcgccgtcatttccggcgtcaccttcttgttcatggccatcaagctgcacctcggcatcaaaaacggtggcaaggtcaagcctctgaagctgtttattttgtccaacaactacttggcagtcctcttcgtggcattgtccgtcgacgcggtcctcggccttgagaccatcggcgagatgctcggctggaccaccaccttcttctaaaagcttgcttttcgacgaaa

SEQ ID NO: 668 - protein, 310 aa, Corynebacterium glutamicum
LDTIKAYIALTKPRVIELLLVATIPTMLQAERGENNIVLILLTVFGGWMGAAAANTFNMVADSDIDQRMGRTRARPLVRHTVSNRDASIFAWVLTVASFLWLWLLCDSMLAGIFVLITIFFYIFVYTKWLKRRTHMNIVWGGAAGCMPVLVGWAVIVDQFEPGVPQQWWQAIVLFMVIFFWTPPHTWALAMKYREDYKAAGVPMLPVVRTPVQVTAQIVWYSVATVLTTFLLIPATGWIYAAIAVISGVTFLFMAIKLHLGIKNGGKVKPLKLFILSNNYLAVLFVALSVDAVLGLETIGEMLGWTTTFF

SEQ ID NO: 669 - DNA, 1161 bp, Corynebacterium glutamicum
  CDS (101)..(1138): RXA02743
atatccttaaaagttcccgggagtttcagtggcaaataccaccacttccataccgggaacaattgtataaaactagccatgacctgctaggatcagcgacgtgtctacttcagatgctccctcaaataatccagttgagttgaagcccattactttctgggcaccgaccatcaaagtgcagcgcattctcgcgctcctactgttgattttccagggaggcatcaccgttacgggctctatcgtccgtgtcacaggctccggcctcggttgtgatacctggccactatgccacgaaggttcactagtcccagtcgcaggcgcagcaccatggatccaccaggcagtggaatttggtaaccgcatgctcactttcgtgcttgctgccgcagcgcttgcgttgttcattgcagttcttggcgcaaaacgccgccgcgagatcctggtccattccttcatccagggtttgggcatcatcttgcaggctgtcatcggtggcatcaccgtgctggttgatttgcactggtacgccgttgctttgcacttcctgccatccatgatccttgttttcatggccgcgattttgtacacccgcatcggcgagcccgatgacggcgagattaccaccacattccccacgtggatccgcaatgtagctgtcattggtgcagtagcgctctccgtagtactgatcaccggcaccatgaccaccggcgctggcgttcactctggcgatgcatcaatcaccatggatgatcgcctcgatgtcagcatcgacttgatggcccacatccacggctacagcatgtacatctacctcttcttcaccctcatcgtggtcgccggtctgtacaaggcaaaaaccaccaagcacaacaagcagcttggcctcatgctgattctgttcattctgattcaggcaggtatcggcatcttgcagtaccgcatgggtgtgccacgctggagcatcccattccacatcgcaatgtcttctgtcgttgttgccttcacttcccttctgtgggcgcagggtcgtatacgcgtcggcggtaaagccaccgttactggttctgttgatggcgatattaagaacgagatcattacgaacccctttgagaagaaatcaaagcagcctgttaaataacacgcaactgtatcggtaaa

SEQ ID NO: 670 - protein, 346 aa, Corynebacterium glutamicum
VSTSDAPSNNPVELKPITFWAPTIKVQRILALLLLIFQGGITVTGSIVRVTGSGLGCDTWPLCHEGSLVPVAGAAPWIHQAVEFGNRMLTFVLAAAALALFIAVLGAKRRREILVHSFIQGLGIILQAVIGGITVLVDLHWYAVALHFLPSMILVFMAAILYTRIGEPDDGEITTTFPTWIRNVAVIGAVALSVVLITGTMTTGAGVHSGDASITMDDRLDVSIDLMAHIHGYSMYIYLFFTLIVVAGLYKAKTTKHNKQLGLMLILFILIQAGIGILQYRMGVPRWSIPFHIAMSSVVVAFTSLLWAQGRIRVGGKATVTGSVDGDIKNEIITNPFEKKSKQPVK

SEQ ID NO: 671 - DNA, 444 bp, Corynebacterium glutamicum
  CDS (101)..(421): RXA01227
ggataatcgaaaatatgtgccccttggtgaagggtcggggagctaataggatgacagtgaacctattttccacgtctttatccgtagtattggagatccgatgacctacacaatcgcccagccctgcgttgatgtcctggatcgagcctgcgtcgaggaatgtcccgtggactgcatctacgagggcaaacggatgctctacatccaccccgatgagtgcgtcgactgcggtgcctgcgagcccgtctgcccggttgaagccatcttctacgaagatgatgttccccacgaatggtgggactacaccggcgctaacgccgcctttttcgacgacctcggttcgccaggcggtgccgccagcctgggtccgcaggacttcgacgcccagctcgtcgcggtgctgccgccacagaaccagaactaggacctgatatcggccctaaa

SEQ ID NO: 672 - protein, 107 aa, Corynebacterium glutamicum
MTYTIAQPCVDVLDRACVEECPVDCIYEGKRMLYIHPDECVDCGACEPVCPVEAIFYEDDVPHEWWDYTGANAAFFDDLGSPGGAASLGPQDFDAQLVAVLPPQNQN

SEQ ID NO: 673 - DNA, 438 bp, Corynebacterium glutamicum
  CDS (101)..(415): RXA01865
ggtggaatttggcctgcggtcaaggggaagtagcataataagcctaaagctttcccatatttattagcctcttagagttctcaggagaaaacgaaatcccatgacatacacaatcgcacagccctgcgttgacgtcttggatcgtgcctgcgttgaagaatgcccagtagattgcatctacgaaggtaagcgcatgctgtacatccacccggatgagtgcgttgactgtggtgcatgtgagcctgcttgcccagttgaggcaatcttctacgaggacgatgtcccagacgaatggcttgactacaacgatgccaacgctgcattcttcgatgatctgggctccccaggtggtgcggctaagcttggaccacaagattttgatcacccaatgatcgctgcgctgccgcctcaggcataatctaacgcatgacctctcgc

SEQ ID NO: 674 - protein, 105 aa, Corynebacterium glutamicum
MTYTIAQPCVDVLDRACVEECPVDCIYEGKRMLYIHPDECVDCGACEPACPVEAIFYEDDVPDEWLDYNDANAAFFDDLGSPGGAAKLGPQDFDHPMIAALPPQA

SEQ ID NO: 675 - DNA, 441 bp, Corynebacterium glutamicum
  CDS (101)..(418): RXA00680
ttcttgcatccccagaagccgaatacatcactgggcaaacactcatcgttgatggtggccgacagttcatctaagtactaaaagttctaaggagaagatcatgtctactattcatttcattgatcatgctggcaaaacccgcaccatcgaggcgactgttggtgattcagtaatggagaccgcagtccgaaacggagtgcctggaattgttgctgaatgcggcggttccttatcgtgtgcaacctgccatgtgtttgttgaccctgcacagtatgatgcgcttcccccaatggaggagatggaagatgaaatgctgtggggtgctgccgtggaccgtgaggattgctcccgtttgtcttgccaaatcaaggtcaccgaaggcatggatctttcgttgaccacgccagaaacgcaagtgtgaggttgaatcatgaatacttc

SEQ ID NO: 676 - protein, 106 aa, Corynebacterium glutamicum
MSTIHFIDHAGKTRTIEATVGDSVMETAVRNGVPGIVAECGGSLSCATCHVFVDPAQYDALPPMEEMEDEMLWGAAVDREDCSRLSCQIKVTEGMDLSLTTPETQV

SEQ ID NO: 677 - DNA, 1389 bp, Corynebacterium glutamicum
  CDS (101)..(1366): RXA00679
ggaccgtgaggattgctcccgtttgtcttgccaaatcaaggtcaccgaaggcatggatctttcgttgaccacgccagaaacgcaagtgtgaggttgaatcatgaatacttcagctgaaactggaatcttgatcatcggtgcaaaccaatcgggtgtgcagctggcgatttccctgcgggccacgggtttcaccgaatcgatcacgcttctaggcgaggaggatcaccgcccctaccagcgtcccgccttgtccaaggagttcctccaggacaagatcgacaaagagcgtctgattttccgttccaatgagtattgggaagaaaataatattcgcctggtcaagggcgtgcgcatcgaacgcattgaaaagaacgacgacggatcaggggtcgcctacggcgccggacaagaattcgcttttcgacgtctcgctctagcggttggtgcccgccctcgccacctcgacctcccgggcgccaccttggagggtgtcacctacctgcgcaacgcggacgacgccttggcgctcaaagcgatgattggttctgtcaccgatgccgttgtagtcggtggtgggttcatcggattggaagctgcgtgttcgcttcatgacctcggcaaaaatgtcaccgtcctggaatatggtccgcgtctgattggccgagcggtgggtgaagaaaccgcagcattcttcctcgaacaacaccgttcccgtggcgtaaatatcgtgcttgatgcccgcatgaaacagtttgtgggcaaggatggaaagctcagcggcattgagctagaagatggcacagtaattcctgcccaactagtcattgtgggcatcggtgtcattccgaacacagaacttgccgctgttctgggcttagacatcaacaacggcatcgtggtggataaacatgccgtcgcgtcagatggcaccaccattgcgattggcgatgtcgccaacattcccaatccaatccctggttcccccgctgatgaacgcatccgactagaaagcgtcaataacgccatcgagcacgcaaagatcgctgcatactcactcgtcggccagcccgaagcctacgccggaatcccctggttctggtccaaccaaggcgatctcaaactacaaattgcaggacttacccttggttatgacagcacagtaatccgacaggatcccgagaaaaagaagttctctgtcctttattaccgtggcgacaacatcatcgccgccgattgtgtcaacgctccactggatttcatggctgtgcgcagtgcactttccaggaaccaaaatatccccgccgaccttgctgcagatatttcgcagccgctgaaaaaactagccgttgacctggaggttacccgatgactcgcagtaatttacccgct

SEQ ID NO: 678 - protein, 422 aa, Corynebacterium glutamicum
MNTSAETGILIIGANQSGVQLAISLRATGFTESITLLGEEDHRPYQRPALSKEFLQDKIDKERLIFRSNEYWEENNIRLVKGVRIERIEKNDDGSGVAYGAGQEFAFRRLALAVGARPRHLDLPGATLEGVTYLRNADDALALKAMIGSVTDAVVVGGGFIGLEAACSLHDLGKNVTVLEYGPRLIGRAVGEETAAFFLEQHRSRGVNIVLDARMKQFVGKDGKLSGIELEDGTVIPAQLVIVGIGVIPNTELAAVLGLDINNGIVVDKHAVASDGTTIAIGDVANIPNPIPGSPADERIRLESVNNAIEHAKIAAYSLVGQPEAYAGIPWFWSNQGDLKLQIAGLTLGYDSTVIRQDPEKKKFSVLYYRGDNIIAADCVNAPLDFMAVRSALSRNQNIPADLAADISQPLKKLAVDLEVTR

SEQ ID NO: 679 - DNA, 1074 bp, Corynebacterium glutamicum
  CDS (101)..(1051): RXA00224
gtgatgtcattggtgcatcgggtgctgctgaaaagattgctgagtacctcgcttcagagaacctcatctagccactatcttcacaaaggagaacatttaaatgtctatttcttatgtgctggttgagcagctagatggccgcccagaaccagttacccttgaattgatcactgctgctcgcgcactcggtgacgtcgttgccgttgtcgttggcgagccaggtgccggcgtaaaccttgctgctgagctcggcaattggggtgcagcacaggttgtttccgctgaaatctctggcgcttccaaccgtttgatcttgcctgctgttgatgcgctgcacattttggctgcgaacaacccaggtccaattgttatcgctgcaactgcaagcggtaatgagatcgctggtcgtttggctgcccgtttggcttctggtgtgctcaccgatgtcgtcggaatcaatgccgaccgcaccgcacagcagtccattttcggcgacaccattcaggtgtccgctgcagttggtggcgcttcaccgctgtacaccctgcgtccaggtgcccttgatggcgtggccgttcctgcaaccggtgaattggcaaccattgagatcccaggcgcaaccgccaaggatgtcaccatcacctccttcacgccaagcacccagagcgatcgccctgagctgccacaggcaaaggtcgttatcgcaggtggacgtggtgtcggaagcgaagaaaacttccgcagcatcgttgaaccactggcagatgcattgggcggtgccgttggcgcaacccgcgacgccgttgatctgggctactacccaggcgagtaccaggttggtcagaccggtgtcaccgtgtccccagacctctacatcggcctcggcatttccggtgcaattcagcacacttctggtatgcagaccgcaaagaaggttattgtgatcaacaacgatgaggacgcgccgatcttccagattgcggacctcggtgtcgttggcgacctctttgacatcgcccctgcgctcatcgaagagatcaacaagcgcaagtaggagttttgaacactttttat

SEQ ID NO: 680 - protein, 317 aa, Corynebacterium glutamicum
MSISYVLVEQLDGRPEPVTLELITAARALGDVVAVVVGEPGAGVNLAAELGNWGAAQVVSAEISGASNRLILPAVDALHILAANNPGPIVIAATASGNEIAGRLAARLASGVLTDVVGINADRTAQQSIFGDTIQVSAAVGGASPLYTLRPGALDGVAVPATGELATIEIPGATAKDVTITSFTPSTQSDRPELPQAKVVIAGGRGVGSEENFRSIVEPLADALGGAVGATRDAVDLGYYPGEYQVGQTGVTVSPDLYIGLGISGAIQHTSGMQTAKKVIVINNDEDAPIFQIADLGVVGDLFDIAPALIEEINKRK

SEQ ID NO: 681 - DNA, 909 bp, Corynebacterium glutamicum
  CDS (101)..(886): RXA00225
gtaggcgtcgaaaagcaatgggcgaagcccgcgtagtatgggcgggcaacgctaaaagcgccaaaaacgccaaaaatcgtgaattgaaaggtgagtgtggatgtccacaatcgtggttctggttaaaaatgttccagacacctggtctaagaggactctggaagctgatttcacccttgaccgtgagggtgtagatcgagtcttggatgagatcaatgagtttgctctggagcaggcactgcgcttgcgggagtccaacccggatgctggttaccgcgttgttgcgctgagcgccggccctgccggtggggaagaggcgctgcgtaaggcgctgtccatgggtgctgatgaagcaatccagctcagtgatgatgccttggctggttctgatcttttgggaaccgcttgggcgctgaacaacgctatcaacaccatcgcgggtgttgctctcatcgtgacgggttcggcttcttccgatggttccatgggtgcgcttcctggcgtgttagctgagtaccgccaggtcccagcgttgactaacttgtctgcgctgaaggtcgagggtgcatctattactgccactcgcattgataaccacggcacctatgagttgcaggctgcacttcctgcggttgtgtcgatttccgataaggctgacaagccacgtttccctaacttcaagggcatcatggctgctaagaaggctgagatcaagaagctttccttggctgaaatcggcgtggctccagagcaggttggtctgtctcacgcggcaactgctgttactgctgcagctgatcgtcctgagcgctcccaaggtgatgtcattggtgcatcgggtgctgctgaaaagattgctgagtacctcgcttcagagaacctcatctagccactatcttcacaaaggag

SEQ ID NO: 682 - protein, 262 aa, Corynebacterium glutamicum
MSTIVVLVKNVPDTWSKRTLEADFTLDREGVDRVLDEINEFALEQALRLRESNPDAGYRVVALSAGPAGGEEALRKALSMGADEAIQLSDDALAGSDLLGTAWALNNAINTIAGVALIVTGSASSDGSMGALPGVLAEYRQVPALTNLSALKVEGASITATRIDNHGTYELQAALPAVVSISDKADKPRFPNFKGIMAAKKAEIKKLSLAEIGVAPEQVGLSHAATAVTAAADRPERSQGDVIGASGAAEKIAEYLASENLI

SEQ ID NO: 683 - DNA, 2378 bp, Corynebacterium glutamicum
  CDS (82)..(2355): RXN00606
tgcggtggcgattgctgcgacccaagctggcaccaccagcctcgatggtattttgcactctgatttctggcggagaagccagtgctcacgggtgttattgcggtgctgattgcaatgtccgcgttcactaagtccgcacagttcccgttccacttctggctgcctgaggcgatggctgcggccaccccagtgtcggcgttcctgcacgctgcggccgtggtcaaggcgggtatttacctgttgctgcgctttagcattgtgttccatgatgttgcggtctggaattggttgctgattatcgtcggcatgggtacggccatcatgtcggcgtatttcgcggtgcagaagaccgatctgaagaagctcacggcatattccacggtgtcgcatttgggttggatcgtagcgaccatcggcgtgggcactcctttcgcgctcggcgctgccattgtgcacacgctcagccacgcgctgtttaagtcctcgttgttcatgctcattggcgtgattgatcaccagactggcacgcgcgatattcgtcgcctcggtttcctggtcaagaagatgccgttcacgtttgtgtctgtattaataggtgcgttgtcgatggcatcggttccgccgttgctcggcttcgtgtccaaagaaggcatgatcacagcgttcatggacgcccccatcggcaactcctatgttgtattactgctggtcggcgcagcaatcggcgcggtcctaaccttcacatactccgcgaaactcgtgctcggcgcattcgtcgacggcccacgcgacatgtcacacgtcaaggaagcccccgtctccctctggcttccggccgccctgcctggacttatgtctctgccactagtcctagtactttcgcttttcgacgcccccgtctccgccgcagccacctccgccgcgggggaagcggcgcacatgcacctggcattgtggcacggcatcaacaccccactgttgatttccttgggtgtgctggtggccggaatccttggtgtgctgttccgcaaagagctgtggaaaatcgccgagaccagccctttccccatcgccacaggcaacgacatcctatcgatgctggtttaccgagccaacttgctgggtaaattcttcggtcgcatggctgattcgatgagcccacgcaggcacttggtcagcctcatcgtgctgctctgggcgctggctgcttttgccaccattcacccctcggttcagcttgcaccaaagcaaccgggaattgatcgttggatcgacctcattccgcttgccatcatcgcgctatctgtcttcggcctgctcaccacccgaaaccgcctcagcgcagccgtgcttgtgggtaccgttggtgtgggtgtttccttccagatgctacttctgggcgctcccgatgttgcacttacccagttcctggtagaaggcctcgtcgtggtaatcatcatgatggttgtccggcaccagcctgccaacttcaagcgcatcaagcccagcagaaggcgcagcaccgttcttgtcgccgtccttgctgccttcgccgcattcatggcggtgtggggattgcttggccgtcacgaacgttctgagctggccatgtggtacctcaaccaaggtccagagatcacctctggcgccaacgtggtgaacaccatcctcgtggaattccgtgcactggatacgttgggcgagctctccgtgcttggcatggcagctgtcgtcatcggtgcgatggtggcttccatgcctcgtcatccgtttgccaagggcacccaccctcgcccctttggccaatcacagttgaactccattccgctgcgcatgctgcttaaggtgctggttccagcgctatgcttcttgagcttcatggtgttcatgcgtggacacaatgatccgggaggcggtttcatcgcagccctaattgccggtggcgcgctgatgctcctgtacctgtccaaggccaaagatggccgcattttccgcccgaatgttcctttcattctcactggtgcgggcatcttgatggcagtgttctcgggcgtactgggactcacccacggttctttcctgtacgccatccacttcaacttcgtaggccagcactggaccacctcgatgatcttcgacctcggcgtgtacctggccgtgttgggcatggtgtccatggcaatcaacggcctgggcggatacctgcgcccaggtaccgacaatgcagatctggactacgcccgccgaagtggcccactgccagcaacgccaacggttgaacccgaaccagaaggcgatgaagactggcccgaacccatcaaccccgcaggcgataacaaagaggaggcaaaccgatgattctcgcactgacagtcgcg

SEQ ID NO: 684 - protein, 758 aa, Corynebacterium glutamicum
VLTGVIAVLIAMSAFTKSAQFPFHFWLPEAMAAATPVSAFLHAAAVVKAGIYLLLRFSIVFHDVAVWNWLLIIVGMGTAIMSAYFAVQKTDLKKLTAYSTVSHLGWIVATIGVGTPFALGAAIVHTLSHALFKSSLFMLIGVIDHQTGTRDIRRLGFLVKKMPFTFVSVLIGALSMASVPPLLGFVSKEGMITAFMDAPIGNSYVVLLLVGAAIGAVLTFTYSAKLVLGAFVDGPRDMSHVKEAPVSLWLPAALPGLMSLPLVLVLSLFDAPVSAAATSAAGEAAHMHLALWHGINTPLLISLGVLVAGILGVLFRKELWKIAETSPFPIATGNDILSMLVYRANLLGKFFGRMADSMSPRRHLVSLIVLLWALAAFATIHPSVQLAPKQPGIDRWIDLIPLAIIALSVFGLLTTRNRLSAAVLVGTVGVGVSFQMLLLGAPDVALTQFLVEGLVVVIIMMVVRHQPANFKRIKPSRRRSTVLVAVLAAFAAFMAVWGLLGRHERSELAMWYLNQGPEITSGANVVNTILVEFRALDTLGELSVLGMAAVVIGAMVASMPRHPFAKGTHPRPFGQSQLNSIPLRMLLKVLVPALCFLSFMVFMRGHNDPGGGFIAALIAGGALMLLYLSKAKDGRIFRPNVPFILTGAGILMAVFSGVLGLTHGSFLYAIHFNFVGQHWTTSMIFDLGVYLAVLGMVSMAINGLGGYLRPGTDNADLDYARRSGPLPATPTVEPEPEGDEDWPEPINPAGDNKEEANR

SEQ ID NO: 685 - DNA, 1872 bp, Corynebacterium glutamicum
  CDS (101)..(1849): FRXA00606
atggataaccagactggcacgcgcgatattcgtcgcctcggtttcctggtcaagaaaaatgccgttcacgtttgtgtctgtattaataggtgcgttgtcgatggcatcggttccgccgttgctcggcttcgtgtccaaagaaggcatgatcacagcgttcatggacgcccccatcggcaactcctatgttgtattactgctggtcggcgcagcaatcggcgcggtcctaaccttcacatactccgcgaaactcgtgctcggcgcattcgtcgacggcccacgcgacatgtcacacgtcaaggaagcccccgtctccctctggcttccggccgccctgcctggacttatgtctctgccactagtcctagtactttcgcttttcgacgcccccgtctccgccgcagccacctccgccgcgggggaagcggcgcacatgcacctggcattgtggcacggcatcaacaccccactgttgatttccttgggtgtgctggtggccggaatccttggtgtgctgttccgcaaagagctgtggaaaatcgccgagaccagccctttccccatcgccacaggcaacgacatcctatcgatgctggtttaccgagccaacttgctgggtaaattcttcggtcgcatggctgattcgatgagcccacgcaggcacttggtcagcctcatcgtgctgctctgggcgctggctgcttttgccaccattcacccctcggttcagcttgcaccaaagcaaccgggaattgatcgttggatcgacctcattccgcttgccatcatcgcgctatctgtcttcggcctgctcaccacccgaaaccgcctcagcgcagccgtgcttgtgggtaccgttggtgtgggtgtttccttccagatgctacttctgggcgctcccgatgttgcacttacccagttcctggtagaaggcctcgtcgtggtaatcatcatgatggttgtccggcaccagcctgccaacttcaagcgcatcaagcccagcagaaggcgcagcaccgttcttgtcgccgtccttgctgccttcgccgcattcatggcggtgtggggattgcttggccgtcacgaacgttctgagctggccatgtggtacctcaaccaaggtccagagatcacctctggcgccaacgtggtgaacaccatcctcgtggaattccgtgcactggatacgttgggcgagctctccgtgcttggcatggcagctgtcgtcatcggtgcgatggtggcttccatgcctcgtcatccgtttgccaagggcacccaccctcgcccctttggccaatcacagttgaactccattccgctgcgcatgctgcttaaggtgctggttccagcgctatgcttcttgagcttcatggtgttcatgcgtggacacaatgatccgggaggcggtttcatcgcagccctaattgccggtggcgcgctgatgctcctgtacctgtccaaggccaaagatggccgcattttccgcccgaatgttcctttcattctcactggtgcgggcatcttgatggcagtgttctcgggcgtactgggactcacccacggttctttcctgtacgccatccacttcaacttcgtaggccagcactggaccacctcgatgatcttcgacctcggcgtgtacctggccgtgttgggcatggtgtccatggcaatcaacggcctgggcggatacctgcgcccaggtaccgacaatgcagatctggactacgcccgccgaagtggcccactgccagcaacgccaacggttgaacccgaaccagaaggcgatgaagactggcccgaacccatcaaccccgcaggcgataacaaagaggaggcaaaccgatgattctcgcactgacagtcgcg

SEQ ID NO: 686 - protein, 583 aa, Corynebacterium glutamicum
MASVPPLLGFVSKEGMITAFMDAPIGNSYVVLLLVGAAIGAVLTFTYSAKLVLGAFVDGPRDMSHVKEAPVSLWLPAALPGLMSLPLVLVLSLFDAPVSAAATSAAGEAAHMHLALWHGINTPLLISLGVLVAGILGVLFRKELWKIAETSPFPIATGNDILSMLVYRANLLGKFFGRMADSMSPRRHLVSLIVLLWALAAFATIHPSVQLAPKQPGIDRWIDLIPLAIIALSVFGLLTTRNRLSAAVLVGTVGVGVSFQMLLLGAPDVALTQFLVEGLVVVIIMMVVRHQPANFKRIKPSRRRSTVLVAVLAAFAAFMAVWGLLGRHERSELAMWYLNQGPEITSGANVVNTILVEFRALDTLGELSVLGMAAVVIGAMVASMPRHPFAKGTHPRPFGQSQLNSIPLRMLLKVLVPALCFLSFMVFMRGHNDPGGGFIAALIAGGALMLLYLSKAKDGRIFRPNVPFILTGAGILMAVFSGVLGLTHGSFLYAIHFNFVGQHWTTSMIFDLGVYLAVLGMVSMAINGLGGYLRPGTDNADLDYARRSGPLPATPTVEPEPEGDEDWPEPINPAGDNKEEANR

SEQ ID NO: 687 - DNA, 1653 bp, Corynebacterium glutamicum
  CDS (101)..(1630): RXN00595
cgacgacacccggtccatcgaaccagatgacgatcaatcgcctttgactactagcgctcgttcagtcaccaacccaacagatcaggaggataaagcttaaatggccatggatgttctccttcctattttcgttgcagttccccttgctgcctctgccattgcggtgcttctgccgtggcgtctcatccgcgatattttgcacatcatcgtgcctttcgcgggtatttttgctggcatctggttgtttgcacacaccgctgaacacggcccgattgctcacaacgtgggcctttatgtcggtggcgtggcaatcccctttgctgccgatacgttcagcgccatcatgttgatcaccacctcgatcgttgcggtggctgccaactggtttgccaccatcgtcggtgaaacccgcgcgcgtttctatccagcgctcacattgatgctgatcacgggcgtcaacggtgctctgctgactgccgatctgttcaacttctttgtgttcatcgaagtgatgctgctgccttcctatggtttgatcgccatgaccggaacgtgggcgcgcctagcctctggacgaatcttcgtactagtcaatctctctgcctccacattgctggttgcaggtgtgggaatcgtctacggtgtcataggctcagtcaacatcgcagctctgcaagatgtcgtagagggcaaccccctggttgccagcgcaatgggcatcgtggttattgccatcgcggttaaagccggtgtattcccagtgcacacatggctgccacgcacctatcctggtacatcagcagctgtgatggggttgttctccggtttgcacaccaaagtcgcggtatacatgctctatcgcatttgggtccacatttttaacatggatcccacgtggaattggctgattgtcgcattcatggtgatatccatgctggtcggtggcttcgctggacttgctgaaaactccatccgtcgcgtccttgcctaccaaatggtcaacggcatgccatttattctcatcatgatggcgtttacctctgacgatccacagcgcgcacttgccgctggtctgttgtacaccctgcaccacatgatcaccatcgccgcattggtgctcacttccggcgcaatcgaagaaacctacggcaccggtatgttgtccaagctgtctggccttgcacgccgcgaacccgtcgtcgcagcagtgttcgctgcaggtgccttctctgttgtcggtttcccaccgttttccggtatgtggggcaaagcgctcatcctgctcgagatcgcccgcgtcggcaatattgcagcatggatcgcaatcgccgccatcatcatcgccagcctgggcgcactgctctcgatgatccgcgtgtggcgtgaagtcttctggggtggcgcaatgcaccagcgcggcgtctcgccgcagctgcgcatcagcccagcaaaaatcgccccagcgctcagcctgatcattttatcggtaggcatgttcatcttcgcgggcccgcttatcgacgcgaccctcaccgccaccgacggcctcttgaacaccgatgcataccaacaggctgtgctcggtgaaaatgccatcggagtgccaagccctagctaccagggaggaaactaatgcttaacgccctgaaattc

SEQ ID NO: 688 - protein, 510 aa, Corynebacterium glutamicum
MAMDVLLPIFVAVPLAASAIAVLLPWRLIRDILHIIVPFAGIFAGIWLFAHTAEHGPIAHNVGLYVGGVAIPFAADTFSAIMLITTSIVAVAANWFATIVGETRARFYPALTLMLITGVNGALLTADLFNFFVFIEVMLLPSYGLIAMTGTWARLASGRIFVLVNLSASTLLVAGVGIVYGVIGSVNIAALQDVVEGNPLVASAMGIVVIAIAVKAGVFPVHTWLPRTYPGTSAAVMGLFSGLHTKVAVYMLYRIWVHIFNMDPTWNWLIVAFMVISMLVGGFAGLAENSIRRVLAYQMVNGMPFILIMMAFTSDDPQRALAAGLLYTLHHMITIAALVLTSGAIEETYGTGMLSKLSGLARREPVVAAVFAAGAFSVVGFPPFSGMWGKALILLEIARVGNIAAWIAIAAIIIASLGALLSMIRVWREVFWGGAMHQRGVSPQLRISPAKIAPALSLIILSVGMFIFAGPLIDATLTATDGLLNTDAYQQAVLGENAIGVPSPSYQGGN

SEQ ID NO: 689 - DNA, 865 bp, Corynebacterium glutamicum
  CDS (101)..(865): FRXA00608
cgacgacacccggtccatcgaaccagatgacgatcaatcgcctttgactactagcgctcgttcagtcaccaacccaacagatcaggaggataaagcttaaatggccatggatgttctccttcctattttcgttgcagttccccttgctgcctctgccattgcggtgcttctgccgtggcgtctcatccgcgatattttgcacatcatcgtgcctttcgcgggtatttttgctggcatctggttgtttgcacacaccgctgaacacggcccgattgctcacaacgtgggcctttatgtcggtggcgtggcaatcccctttgctgccgatacgttcagcgccatcatgttgatcaccacctcgatcgttgcggtggctgccaactggtttgccaccatcgtcggtgaaacccgcgcgcgtttctatccagcgctcacattgatgctgatcacgggcgtcaacggtgctctgctgactgccgatctgttcaacttctttgtgttcatcgaagtgatgctgctgccttcctatggtttgatcgccatgaccggaacgtgggcgcgcctagcctctggacgaatcttcgtactagtcaatctctctgcctccacattgctggttgcaggtgtgggaatcgtctacggtgtcataggctcagtcaacatcgcagctctgcaagatgtcgtagagggcaaccccctggttgccagcgcaatgggcatcgtggttattgccatcgcggttaaagccggtgtattcccagtgcacacatggctgccacgcacctatcctggtacatcagcagctgtgatggggttgttctccggtttgcacaccaaagtcgcggtatacatgctctatcgcatt

SEQ ID NO: 690 - protein, 255 aa, Corynebacterium glutamicum
MAMDVLLPIFVAVPLAASAIAVLLPWRLIRDILHIIVPFAGIFAGIWLFAHTAEHGPIAHNVGLYVGGVAIPFAADTFSAIMLITTSIVAVAANWFATIVGETRARFYPALTLMLITGVNGALLTADLFNFFVFIEVMLLPSYGLIAMTGTWARLASGRIFVLVNLSASTLLVAGVGIVYGVIGSVNIAALQDVVEGNPLVASAMGIVVIAIAVKAGVFPVHTWLPRTYPGTSAAVMGLFSGLHTKVAVYMLYRI

SEQ ID NO: 691 - DNA, 2118 bp, Corynebacterium glutamicum
  CDS (1)..(2118): RXA00913
attatttccgtggtgggcattggtacccgcgaagctttgctggcaggtcttgcactgaccgttgcgcactccttgtttaaggcaacattgttcatgacagttggtgccattgaccacaccaccggaactcgtgatattcgtaaactctccggtctgtggcgtaaacaaccgatcctgttcgccgttgctgctgtttcggcggcgtccatggctggtattccgccactgtttggttttatcgccaaggaaacagcgctggataccgtgttgaatgagcagatgttgcatggcatgccaggtcgattgatgctggctggcatcgttttgggttccatcttcaccatggcatattcctgctacttcctgtacgaagcctttgccacgaagcactccaaattcccagaggccaacggtgtctcacctgcagtggaggcaatgcatccggtgaagtttaagctgtggatcgcacctgtcatcctggctattttgaccgtagtgtttggtgttttccccaagccagtgtcggaagcaattgtcacgcatcttgataacgtcacgccatcgcttgatgatgtccacaccaaactggccttgtggcatggtctgaatctaccgctgctgctgtctgtggtgatcatcatttccggattcatcatcttctgggagcgagacaccgtcgaacgtttgcgccctaacaccgcagcgtttggcagtgccgataccgcctacgacgccattcttgatgcactgcgtgtgctctcccaccgcctgactgcatccacccagcgtggttctttgaccctgaacgtcggtgtgatcttcttcgtcctcacgattgttccgctgatcgctttgatcactggcgaacaaagcgatgtccgcatggagctgtgggatagccctattcagggcttcatcgcggccatcattatcgtcgttgcgattgtggcaaccaccatggataaccgtttgtctgcgctgattttggtgggtgtgacaggttatggcattgccgttatcttcgcgctacatggcgcaccggacttggcgctaacccaggtgctggtggagaccatcgtcatggtggtattcatgctggtgctgcgtaaaatgccgacagaagttgcgtggaaggcagaacctaaacagtctcgcgtgcgagcgtggcttgctggcgccaccggattgtccgttgttattgtcaccatttttgccatgaatgctcgcaccactgaaccgatctctgtatacatgcaggatctggcctatgagatcggacatggcgcaaacaccgtcaacgtactgctcgtagacctgcgtggttttgataccttcggtgaaatttccgtccttgtgatcgcggcaaccggtatcgcctccctggtctaccgaaaccgcagcttccgcaaggattctcgcagaccaaccctggctaccactggtcgccgttggttggctgctgctgttgataccgaaagggcgcagaaccgctcgctgatggttgatgtggcaacgcgcatcctcttccctgccatgatcatgttgtctgtgtacttcttcttcgccggacacaacgcgccgggcggcggattcgccggcggccttgttgcctccttggcgttcgccttgcgctaccttgccggtggacgtgaagaacttgaagaagcgttgcctatcgacgccggccgtatcttgggaactggactatttgtttctgcaactgcagtgctgtggcccatggttcttcttggtgaaccaccgctgacctcccatatttgggatctcacactgccacttatcggtgagattcacattgcatccgcgctgctctttgaccttggtgtctacctgatcgtcatcggtttgaccatgcacattctcaacagtttgggcggccagctcgaccgcgatgaggaaatgcgtaagcagcgtgcgcgcgaccgagctcgacgcttggcgcgcaaccagcgtcgagaagcagcaaccgtcggcgcacgcaggtcgaacgagaaatcgacacgccaaatgccgacgattcggcctccaggggcagacacagaatcggtggagcagaacggtgagaaccagacgtcgataagcacaaagcgtttaaagcag

SEQ ID NO: 692 - protein, 706 aa, Corynebacterium glutamicum
IISVVGIGTREALLAGLALTVAHSLFKATLFMTVGAIDHTTGTRDIRKLSGLWRKQPILFAVAAVSAASMAGIPPLFGFIAKETALDTVLNEQMLHGMPGRLMLAGIVLGSIFTMAYSCYFLYEAFATKHSKFPEANGVSPAVEAMHPVKFKLWIAPVILAILTVVFGVFPKPVSEAIVTHLDNVTPSLDDVHTKLALWHGLNLPLLLSVVIIISGFIIFWERDTVERLRPNTAAFGSADTAYDAILDALRVLSHRLTASTQRGSLTLNVGVIFFVLTIVPLIALITGEQSDVRMELWDSPIQGFIAAIIIVVAIVATTMDNRLSALILVGVTGYGIAVIFALHGAPDLALTQVLVETIVMVVFMLVLRKMPTEVAWKAEPKQSRVRAWLAGATGLSVVIVTIFAMNARTTEPISVYMQDLAYEIGHGANTVNVLLVDLRGFDTFGEISVLVIAATGIASLVYRNRSFRKDSRRPTLATTGRRWLAAAVDTERAQNRSLMVDVATRILFPAMIMLSVYFFFAGHNAPGGGFAGGLVASLAFALRYLAGGREELEEALPIDAGRILGTGLFVSATAVLWPMVLLGEPPLTSHIWDLTLPLIGEIHIASALLFDLGVYLIVIGLTMHILNSLGGQLDRDEEMRKQRARDRARRLARNQRREAATVGARRSNEKSTRQMPTIRPPGADTESVEQNGENQTSISTKRLKQ

SEQ ID NO: 693 - DNA, 955 bp, Corynebacterium glutamicum
  CDS (101)..(955): RXA00909
tcgatgtgtgttgctaactgggggtggcacgcacgttggcgttgttgtttggtgtggctccagagtaatccacaacgcgcaaaggggaactggagaacacgtgctcattctttttctcgcgctcactgcagccgcagtagtcgcccccatcctgatccgaactctcggtcgaccagcttttggtctgctggcgcttgtacctggcattggttttttctgggtgctttcggagttcatcaaaggcactttcaaggatggaggtgaactcctcctccactatgcctggatgccttcggctcacctcaatatcgatttccgtatggattccctcgcggcgctgttctcactcatcgtcttaggcgtgggcgccctagtgctgctgtactgctggggatattttgattccaacgcgggtcgcctcagtgcctttggtgctgaactggtggccttcgccatggcgatgtttggtcttgtcatttcagacaacatcctgctgatgtacgtcttctgggaaatcacctccgttttatccttcctcctggttggttattacggcgaacgcgcatcttcacgtcgctctgcaggtcaagccttgatggtgaccaccctgggtggattggccatgctggtgggcatcattttgatgggtacccaaactggcgtgtggcgattctctgagatccctgcctactcaagctcctgggcagatgtgccgtatatttccgctgctgctgcccttatcttggctggcgcactatccaaatcggctatcgcaccaacccacttctggcttcccggcgcgatggccgcaccaacgccggtgtctgcttacctgcactccgcagcgatggtgaaggcgggtatttaccttgtggctcgcctctctccagacctcaacgtagttggttcgtggtacctgatcatcatcccgttgggcatgttgaccatgctcatg

SEQ ID NO: 694 - protein, 285 aa, Corynebacterium glutamicum
VLILFLALTAAAVVAPILIRTLGRPAFGLLALVPGIGFFWVLSEFIKGTFKDGGELLLHYAWMPSAHLNIDFRMDSLAALFSLIVLGVGALVLLYCWGYFDSNAGRLSAFGAELVAFAMAMFGLVISDNILLMYVFWEITSVLSFLLVGYYGERASSRRSAGQALMVTTLGGLAMLVGIILMGTQTGVWRFSEIPAYSSSWADVPYISAAAALILAGALSKSAIAPTHFWLPGAMAAPTPVSAYLHSAAMVKAGIYLVARLSPDLNVVGSWYLIIIPLGMLTMLM

SEQ ID NO: 695 - DNA, 927 bp, Corynebacterium glutamicum
  CDS (101)..(904): RXA00700
acgccccacaagtcgcaaaaatcaccgccggcatccaagaggaatcacactggctcacagtctcggccgtgaaagctgcgctagggcatggtgaaatctcatgatcaacgccatcacactcaagcccaaaaccttcctcaccttaagcttccttgcggttttgagcatcgtgattttcttctggccgctgatcgtcaacccggaatccttcctgtccgacaaagcccaagcgcccctctacatcgcgatcgtcattcccctcgtgctggccgctgtcatcgccgaaatcagtgaaaacggattcgacgttaaagccgtagccatgctcggcgtcctcaccgccatggttgccgtagtccgaccattcggtgccggcgcagcaggctttgaagcagtcttctttgtcctcatcctcggcggacgagccttcggacccggcttcggattcatcctcggcaacaccggactgttcgcatccgcgctgctcaccgcaggaatcggaccgtggctcccctaccaaatgctcgcagccgcctgggtcagcttcggcgccggcctactcccccaagtacgcggcaaaaaggaaatgctcatcatcgtcctatacgccatcgtctcttcactcggctacggaaccatgatgaacatgagcttctggccctacgccatcggtgtcaccagcgggctttccttcacacccggcgcgcccgtcctggaaaacctccacaccttcatgctgttctgcctcaccacatccatgggttgggatctcggccgcgccttcttcacctcagtgctattactgctcacagccaaacccgttttaggtgctttacgacgcgccagccgccgcgccgctttcggcgtcgagcgtgacttcggggaggccggggtgcctcgggtctaaagattttgttggcttgcttc

SEQ ID NO: 696 - protein, 268 aa, Corynebacterium glutamicum
MINAITLKPKTFLTLSFLAVLSIVIFFWPLIVNPESFLSDKAQAPLYIAIVIPLVLAAVIAEISENGFDVKAVAMLGVLTAMVAVVRPFGAGAAGFEAVFFVLILGGRAFGPGFGFILGNTGLFASALLTAGIGPWLPYQMLAAAWVSFGAGLLPQVRGKKEMLIIVLYAIVSSLGYGTMMNMSFWPYAIGVTSGLSFTPGAPVLENLHTFMLFCLTTSMGWDLGRAFFTSVLLLLTAKPVLGALRRASRRAAFGVERDFGEAGVPRV

SEQ ID NO: 697 - DNA, 1587 bp, Corynebacterium glutamicum
  CDS (101)..(1564): RXN00483
agacccaagagtaaaatcccaggatttgcttatacttgcgctcatggataatcaacttcgtcccactttgcattatcaagctcaaaacccgcaccggcgagtgctggtcaccggtgcgacaggctacattggcggcaggttgattactgagttacttgctgccggtttccaagttcgggccacctcgaggaaaaaaacaagtcttcagcgctttgactggtacgaggacgtcgaggcagtggaagcggatctgactgacgcgactgagttagatacgttatttaaggatgtagacgttgtttactatctagtgcattccatgggaggtaagaatgttgattttgaagagcaagagcaacgcactgctgaaaatgtaattcaagctgctgatcaagccgggataaaacagattgtctacctttccggcttacacccgcgtaatcgaaaaatagaagaactatctaagcacatgcgctcacgggaaaaggtcgcccagattttgctggcaggccagacaccagctttaattttaagggctgccacaattattggttccggctctgcatcatttgaaataatccgtcatctcacggagcgtttgcctagaatgatagcgcctcagtggattactaatcagattgagcctttagcaatacgggatgttttgcattacctaatctcggcggctgatttaaaggatccagtcaaccgctcctgcgatattgggtgtggaaagtcgtatgaatttgcggatctattgcgtatctatgccgatgttcggggactgaaacgtcatgtaaattccgtacctctcaatttgcccatggacaagctatccggtctttggattagtctagtgacacctgttccatttcaattgtctttccctttagctcaatcaatggctgaggatgccgtcactgaagagcacagcattaaagatattatttcagatccacccgatggttttattgagtatcgggaagcagtggagctggcattagctgcagaatttgatcgtggagttccaacgtcatgggatcgaagctggactgtacaacaaccgtgggctggccagcctaccgatccagagtgggcgggcaaagctgtatatgaagacgtccgcacagaagatactgatctccgagcagcgcaggtctggccgatcattgaaggtttgggtggcgtgaacggctggtattctgcaccactgctatggcgattgcggggtatcgctgacagactcatcggcggtccaggtttgggcggacggcgggatccccgtcatttgaaacttggggatcgcattgattggtggcgggttactgagatcgatccaccacatagattagtgctcaccgcagagatgaaagtagatggtggcgcttggctgatcctggaagttgcggacaaggaaaatggcggatgtacttatacccagcgcgcaatatttgagccgaagggtttgcccggttatctctattggtgggttgtttcaccgttccatgcgattatttttccttatatgcgttcgaatattttaaaagctgcgcgtaaactcacttaatcgcagagtaggcgtctaaa

SEQ ID NO: 698 - protein, 488 aa, Corynebacterium glutamicum
VLVTGATGYIGGRLITELLAAGFQVRATSRKKTSLQRFDWYEDVEAVEADLTDATELDTLFKDVDVVYYLVHSMGGKNVDFEEQEQRTAENVIQAADQAGIKQIVYLSGLHPRNRKIEELSKHMRSREKVAQILLAGQTPALILRAATIIGSGSASFEIIRHLTERLPRMIAPQWITNQIEPLAIRDVLHYLISAADLKDPVNRSCDIGCGKSYEFADLLRIYADVRGLKRHVNSVPLNLPMDKLSGLWISLVTPVPFQLSFPLAQSMAEDAVTEEHSIKDIISDPPDGFIEYREAVELALAAEFDRGVPTSWDRSWTVQQPWAGQPTDPEWAGKAVYEDVRTEDTDLRAAQVWPIIEGLGGVNGWYSAPLLWRLRGIADRLIGGPGLGGRRDPRHLKLGDRIDWWRVTEIDPPHRLVLTAEMKVDGGAWLILEVADKENGGCTYTQRAIFEPKGLPGYLYWWVVSPFHAIIFPYMRSNILKAARKLT

SEQ ID NO: 699 - DNA, 1587 bp, Corynebacterium glutamicum; identical to SEQ ID NO: 697
  CDS (101)..(1564): FRXA00483

SEQ ID NO: 700 - protein, 488 aa, Corynebacterium glutamicum; identical to SEQ ID NO: 698

SEQ ID NO: 701 - DNA, 612 bp, Corynebacterium glutamicum
  CDS (101)..(589): RXA01534
attgctctcatcggttcgatatagactgaattgtctaggttaatatccaatatggaagaaaaactagacagttaagtagactgaatggcctactaggtgcatgacttcagcaatcaccaccgcaactgatcttcgctccgtactgcgaaacgtaccaaccccaattagcttcattgcaacccacaccgatcagcctctgggcatgatcgttggttcattcgtcagcattagcgccgaaccaccattggtaggcatcttcttgcagaagagctcttcttcatggccagctatcgagcaggcattagttaccggccaagagctaggcatttctatcctcggcggggcacacgcagaccatgtgcgtaagctttctggcccatccgaccagcgctttgaaaaccttgggtgggcatccaccgaaaacggtgcgattcaccttgaaggcgctgatgcacaactaaccacgaaacttcatgatctccaggaaatcggcgatcacttctttgcagttctagaagttattgacgcttccgctgaccaagacttcagctcagcgctggtgtaccaccgctcacaggtgtcctcgctgtaggacactaaattttaagaggg

SEQ ID NO: 702 - protein, 163 aa, Corynebacterium glutamicum
MTSAITTATDLRSVLRNVPTPISFIATHTDQPLGMIVGSFVSISAEPPLVGIFLQKSSSSWPAIEQALVTGQELGISILGGAHADHVRKLSGPSDQRFENLGWASTENGAIHLEGADAQLTTKLHDLQEIGDHFFAVLEVIDASADQDFSSALVYHRSQVSSL

SEQ ID NO: 703 - DNA, 1134 bp, Corynebacterium glutamicum
  CDS (101)..(1111): RXA00288
ggcgtgctaaaaaagcacgtcaaatacagaatcggcagattacatcgctgagcagagaaaacacgggcatgaaacgtacccaagggctaacatcgggggcatgagcgcgcaaatggatacccctgatcccactatgtctgctgttgcaatgttagattccatcccttctgatcaaccagatttcctgatcgatgtagaagtagatcgaccaactcccggaccacatgatctgctagtccacattgaggcggtctcaattaaccctgttgataccaaggtacgcatgcgggccgggaagcaaaagcatcctaaaattttaggttttgatgctgcaggtgaggtggtggctgttggatcgcaggtcacgctcttcaatgttggtgacaaagtgttctacgcaggatccaatcagcgtccaggaagtaacgcagagtaccaggtggtggatgaacggctggtgggtcacgcaccacaaagcttgggggcacacgacgccgctgctctcccacttgtcgcgctcactgcatgggagtcactttttgaccgattgggagtaactcagtcaactactggaacactgttggtcttgggcggttcaggaggtgtgccttcagctcttattcaacttgctcgagctctcactggtctgaaagtagtggcaacagcttctcgccctgaatcacaagaatgggtgacaaagctcggtgctcatgaggtgattgatcactccaaggatttgagtgagcaaatctccgacgtggattttgttttcagctcgtggactactgggcgtgaagtagagctcgccacgttgatgaaaccccagtcccacctagtgctcatcgatgatccagtggatcccaatttgggcgcttttaagcaaaaagcgatcgctttgcactgggagttcatgtttacccgcgctatgttcaacactcctgatatgggtgaacaagggaaaattctgaataagatcgccgacatggttgatcggggtcagtttgagtccgtgacagcaacggtgctggatgggctcaacgctgcaaacatcatggaggggcaccggctcgttgagcagggtaaaacctcaggaaaaattgttgtgagggtataaagaggacttgaaaaatgcac

SEQ ID NO: 704 - protein, 337 aa, Corynebacterium glutamicum
MSAQMDTPDPTMSAVAMLDSIPSDQPDFLIDVEVDRPTPGPHDLLVHIEAVSINPVDTKVRMRAGKQKHPKILGFDAAGEVVAVGSQVTLFNVGDKVFYAGSNQRPGSNAEYQVVDERLVGHAPQSLGAHDAAALPLVALTAWESLFDRLGVTQSTTGTLLVLGGSGGVPSALIQLARALTGLKVVATASRPESQEWVTKLGAHEVIDHSKDLSEQISDVDFVFSSWTTGREVELATLMKPQSHLVLIDDPVDPNLGAFKQKAIALHWEFMFTRAMFNTPDMGEQGKILNKIADMVDRGQFESVTATVLDGLNAANIMEGHRLVEQGKTSGKIVVRV

SEQ ID NO: 705 - DNA, 1089 bp, Corynebacterium glutamicum
  CDS (101)..(1066): RXA02741
actggtcacctggtttggtctgcactctgactcccctcaaaagggcacaatttggtcaatttcccaaccttgtctttcagtcatggttagtgtgggaaccatgaaggcaatcttagtttcccgcaccggcggaccagaggtgttggagttcaccgacactgacgccccaaagcccactgatgatcaggttttagttgaagttgatatggctggcgtcaactttattgatacttactatcgccagggtgaatatcacgctcgcctgccgtttatcccaggttttgaaggcactggtcgggtgttggaggatccgcaggggttgattgcggcgggtaccaaggtggcgtggtgtgatgccatgggttcgtatgctcagcaggtgtgtgtgccgcgggatcgcttggtggcggttcccgagggcgtgagttcggaagtggctgcgtcgatgttgatgcagggaatcactgcgcattatctaaccaatggtgtgtatgagcttgaagagggcgattcttgcctcatcactgctggcgcgggtggtgttggattgttggctacgcagatggcggcggccaagggagtgcgcgtgtacagcgtggtgtccacggatgaaaaagctgagcttgctttggatgccggtgcttatgaggtgtttcgttattccgataatttggcggagcaggttcgtcggcacaacgggggtcgcggagttgatgtggtgtatgacggtgtcggccagtccacgttcaatgagtccttagaggctgttcgtccgcgcggcactgtgtgtttgtttggtgcggcgtcgggtcctgtggagccttttgatccgcagctgttgaacactcacggttcgatcttcttgacccgcccaagcattggcgcgtggacgtctgaggagggcgaatttgccaagcgtgcacaggcggtcacgcaggccatcgtcgaaggcaccttgcgggttcgcgttactggcacatattcgcttgccgacgcctacatcgcccaccgcgaccttcaggcgcgtagcacgagcggttctttggtcttggaaatcccgaaggactaaacacgcataaaaagatcctg

SEQ ID NO: 706 - protein, 322 aa, Corynebacterium glutamicum
MKAILVSRTGGPEVLEFTDTDAPKPTDDQVLVEVDMAGVNFIDTYYRQGEYHARLPFIPGFEGTGRVLEDPQGLIAAGTKVAWCDAMGSYAQQVCVPRDRLVAVPEGVSSEVAASMLMQGITAHYLTNGVYELEEGDSCLITAGAGGVGLLATQMAAAKGVRVYSVVSTDEKAELALDAGAYEVFRYSDNLAEQVRRHNGGRGVDVVYDGVGQSTFNESLEAVRPRGTVCLFGAASGPVEPFDPQLLNTHGSIFLTRPSIGAWTSEEGEFAKRAQAVTQAIVEGTLRVRVTGTYSLADAYIAHRDLQARSTSGSLVLEIPKD

SEQ ID NO: 707 - DNA, 990 bp, Corynebacterium glutamicum
  CDS (101)..(967): RXN02560
ttggggcaagccagctaacgcatttcttgtggaaaccgcagacattgaggccgcccacgcggaacttctaagagcagtggaatgaaataatccggtgctgatgcagggcaactcgcttaatctggcagacaacagcgagagaaagaagcccatgccgtcaccaggagaacttttagccgcccgctacggacaacctgcaacctggacgccaccgcagtggaatgagacgcttgatgtcattcaccagcatcgatcagttcgcaggtggttggataaaccggttgatgatgacaccatccgcaccattatttccgccgcacaatcggctggaacctcttccaataagcaggtcatttctgtcatcgtggttaaagatcctgagctgaggaaaggcctcgcggggatcactcgccagatgtttccgcaccttgagcaggttcccgcggtgctgatttggttgattgattattcccgaatcagtgcggtggcagccagagaagatctcccaacaggggctcttgattatctcgatgaggccgcgtgggggttcctcgacgccggaatcgcagctcaaaacgctgcaattgctgcggagtcacttggattgggaacgctctatttgggttcggtgcgcaacgatgcggaagccgtgcacaaattgcttggccttccacctgagatcgtgcctgtcgtgggcttggaaatggggcatgcggatccgcctgaacctgccggaattaaacctcccctgccacaagaagccattgttcactgggatacctacaccgagaaaaacctcgaacttatcgattcctacgaccgcgccctcgacacttactattctcgctacggccagcaccagctctggtcgaagcagacggcgcatagggcggcgtcgaaaagcttttcaaaaaccaacaggcagttccttaggggcgtgtttgagcgcgccgggtttgggctgagataaaagcatgattatggacgcct

SEQ ID NO: 708 - protein, 289 aa, Corynebacterium glutamicum
MQGNSLNLADNSERKKPMPSPGELLAARYGQPATWTPPQWNETLDVIHQHRSVRRWLDKPVDDDTIRTIISAAQSAGTSSNKQVISVIVVKDPELRKGLAGITRQMFPHLEQVPAVLIWLIDYSRISAVAAREDLPTGALDYLDEAAWGFLDAGIAAQNAAIAAESLGLGTLYLGSVRNDAEAVHKLLGLPPEIVPVVGLEMGHADPPEPAGIKPPLPQEAIVHWDTYTEKNLELIDSYDRALDTYYSRYGQHQLWSKQTAHRAASKSFSKTNRQFLRGVFERAGFGLR

SEQ ID NO: 709 - DNA, 922 bp, Corynebacterium glutamicum
  CDS (101)..(922): FRXA02560
ttggggcaagccagctaacgcatttcttgtggaaaccgcagacattgaggccgcccacgcggaacttctaagagcagtggaatgaaataatccggtgctgatgcagggcaactcgcttaatctggcagacaacagcgagagaaagaagcccatgccgtcaccaggagaacttttagccgcccgctacggacaacctgcaacctggacgccaccgcagtggaatgagacgcttgatgtcattcaccagcatcgatcagttcgcaggtggttggataaaccggttgatgatgacaccatccgcaccattatttccgccgcacaatcggctggaacctcttccaataagcaggtcatttctgtcatcgtggttaaagatcctgagctgaggaaaggcctcgcggggatcactcgccagatgtttccgcaccttgagcaggttcccgcggtgctgatttggttgattgattattcccgaatcagtgcggtggcagccagagaagatctcccaacaggggctcttgattatctcgatgaggccgcgtgggggttcctcgacgccggaatcgcagctcaaaacgctgcaattgctgcggagtcacttggattgggaacgctctatttgggttcggtgcgcaacgatgcggaagccgtgcacaaattgcttggccttccacctgagatcgtgcctgtcgtgggcttggaaatggggcatgcggatccgcctgaacctgccggaattaaacctcccctgccacaagaagccattgttcactgggatacctacaccgagaaaaacctcgaacttatcgattcctacgaccgcgccctcgacacttactattctcgctacggccagcaccagctctggtcgaagcagacggcgcatagggcggcgtctaaacgctgttacaagaaccaagaa

SEQ ID NO: 710 - protein, 274 aa, Corynebacterium glutamicum
MQGNSLNLADNSERKKPMPSPGELLAARYGQPATWTPPQWNETLDVIHQHRSVRRWLDKPVDDDTIRTIISAAQSAGTSSNKQVISVIVVKDPELRKGLAGITRQMFPHLEQVPAVLIWLIDYSRISAVAAREDLPTGALDYLDEAAWGFLDAGIAAQNAAIAAESLGLGTLYLGSVRNDAEAVHKLLGLPPEIVPVVGLEMGHADPPEPAGIKPPLPQEAIVHWDTYTEKNLELIDSYDRALDTYYSRYGQHQLWSKQTAHRAASKRCYKNQE

SEQ ID NO: 711 - DNA, 870 bp, Corynebacterium glutamicum; identical to SEQ ID NO: 15
  CDS (101)..(847): RXA01311

SEQ ID NO: 712 - protein, 249 aa, Corynebacterium glutamicum; identical to SEQ ID NO: 16

SEQ ID NO: 713 - DNA, 929 bp, Corynebacterium glutamicum
  CDS (1)..(906): RXN03014
tacgttggtttcgaagtgctgctggtggcgtcatacgtgctgctcaccttgggtgcatcgccggcacgtgtacgttccggcgtgggttacgtgatggtgtccatggcgtcatcgatggtgttcctgtttggactcgcaatggtttacgcctcagtgggcacgttgaacatggctcacgttggcctacgcatggaagatgttccgtctggaactcgctccgcgatcttcgcagtgttgctcgtggcattcggtattaaagctgccgtgttccccctagattcctggctgccggactcctaccccaccgcgccatcgctggtcaccgcggtgttcgcaggtctgttgaccaaggtgggtgtgtattccatcattcgagcacgctcgattattttcaccgatggatcccttgacaccatgctgatgtgggtggcactcgccaccatgctcattggtattttgggcgcgatggcgcaaaacgatatcaaacgtttgttgtcatttactctggtcagccacatcggctacatgatcttcggcgtagcccttggatctgcacagggtttgtctggtgcgatcttctacgcaatccaccacattctggttcagacttccctgttcctggtggtcggtctggtggaacgccaagccggatcctcctcgctgcgacgccttggatccctggcatatatctccccacttcttgcgattttgtacttcatccccgccatcaacctgggtggtatcccaccgttctccggcttcctgggcaagatcatgctcatcgaagccggcgcccgaagatggcagttggctggcatgggtccttatcgcaggcgccgttgtcacctcactgctcaccttgtacaccatggttctggtctggtccaaggccttctggcgcgaccgtaaagacgcccccgatggagcaa

SEQ ID NO: 714 - protein, 302 aa, Corynebacterium glutamicum
YVGFEVLLVASYVLLTLGASPARVRSGVGYVMVSMASSMVFLFGLAMVYASVGTLNMAHVGLRMEDVPSGTRSAIFAVLLVAFGIKAAVFPLDSWLPDSYPTAPSLVTAVFAGLLTKVGVYSIIRARSIIFTDGSLDTMLMWVALATMLIGILGAMAQNDIKRLLSFTLVSHIGYMIFGVALGSAQGLSGAIFYAIHHILVQTSLFLVVGLVERQAGSSSLRRLGSLAYISPLLAILYFIPAINLGGIPPFSGFLGKIMLIEAGARRWQLAGMGPYRRRRCHLTAHLVHHGSGLVQGLLARP

SEQ ID NO: 715 - DNA, 1280 bp, Corynebacterium glutamicum
  CDS (1)..(1257): FRXA00910
tacgttggtttcgaagtgctgctggtggcgtcatacgtgctgctcaccttgggtgcatcgccggcacgtgtacgttccggcgtgggttacgtgatggtgtccatggcgtcatcgatggtgttcctgtttggactcgcaatggtttacgcctcagtgggcacgttgaacatggctcacgttggcctacgcatggaagatgttccgtctggaactcgctccgcgatcttcgcagtgttgctcgtggcattcggtattaaagctgccgtgttccccctagattcctggctgccggactcctaccccaccgcgccatcgctggtcaccgcggtgttcgcaggtctgttgaccaaggtgggtgtgtattccatcattcgagcacgctcgattattttcaccgatggatcccttgacaccatgctgatgtgggtggcactcgccaccatgctcattggtattttgggcgcgatggcgcaaaacgatatcaaacgtttgttgtcatttactctggtcagccacatcggctacatgatcttcggcgtagcccttggatctgcacagggtttgtctggtgcgatcttctacgcaatccaccacattctggttcagacttccctgttcctggtggtcggtctggtggaacgccaagccggatcctcctcgctgcgacgccttggatccctggcatatatctccccacttcttgcgattttgtacttcatccccgccatcaacctgggtggtatcccaccgttctccggcttcctgggcaagatcatgctcatcgaagccggcgccgaagatggcagttggctggcatgggtccttatcgcaggcgccgttgtcacctcactgctcaccttgtacaccatggttctggtctggtccaaggccttctggcgcgaccgtaaagacgcccccgatggagcaaccgcacttgcgcgacccgcacctttggtagatgtccaagacgaagtcgccgttaaagaccgcaacgatgtcggacggatgccttggggcatggtcttctccactgctctcctggtttcagcatctcttgctgtatccgtgctcgcaggaccactgtcatctattactggacgcgccgccgaatccgcacaagatgtcaacatctaccgcgccgcagtactcggccccaactacctcgacccatcacgcacactcgagatggagcgttacgacgccaaccgcgatgacatcaaccaccgcgtcgacaccaacggaacggaggaccaaccatgatcagtggattcaaacgacga

SEQ ID NO: 716 - protein, 419 aa, Corynebacterium glutamicum
YVGFEVLLVASYVLLTLGASPARVRSGVGYVMVSMASSMVFLFGLAMVYASVGTLNMAHVGLRMEDVPSGTRSAIFAVLLVAFGIKAAVFPLDSWLPDSYPTAPSLVTAVFAGLLTKVGVYSIIRARSIIFTDGSLDTMLMWVALATMLIGILGAMAQNDIKRLLSFTLVSHIGYMIFGVALGSAQGLSGAIFYAIHHILVQTSLFLVVGLVERQAGSSSLRRLGSLAYISPLLAILYFIPAINLGGIPPFSGFLGKIMLIEAGAEDGSWLAWVLIAGAVVTSLLTLYTMVLVWSKAFWRDRKDAPDGATALARPAPLVDVQDEVAVKDRNDVGRMPWGMVFSTALLVSASLAVSVLAGPLSSITGRAAESAQDVNIYRAAVLGPNYLDPSRTLEMERYDANRDDINHRVDTNGTEDQP

SEQ ID NO: 717 - DNA, 1051 bp, Corynebacterium glutamicum
  CDS (101)..(1051): RXN01895
cgcgtacacgtgctcaacacgacaacgcttaaacggctgcacgcgtaacacggcagaccgcacaagctttaagatccacgatcaggagactttgacaaatatgtcagttaacccaacccgccccgaaggcggccgtcaccacgtcgtcgtcatcggttctggttttggtggcctttttgctgccaagaacctggccaaggcagacgtcgatgtcactctgattgaccgcaccaaccaccacctcttccagccactgctgtaccaagtggcaaccggtatcctctcctccggtgaaatcgcaccttccactcgacagatcctgggctcccaggaaaacgtcaacgtcatcaagggcgaagtcaccgacatcaacgtcgagtcccagactgtgaccgcctccctgggcgagttcacccgcgtttttgagtacgattccttggtcgttggtgctggcgcaggtcagtcctacttcggcaatgatcacttcgctgagttcgcacctggcatgaagtccatcgacgatgcactggagattcgtgcacgcatcatcggtgctttcgagcgcgctgagatctgcgaggatccagctgagcgcgaacgcctgctcaccttcgtcgttgttggcgctggcccaaccggtgttgagcttgctggccagttggctgagatggctcaccgcacccttgctggtgagtacaagaacttcaacaccaactccgcaaagatcatcctgcttgatggtgctccacaggttcttcctccattcggtaagcgcctaggccgcaacgcacagcgcaccctggaaaagatgggtgtcaacgttcgcctgaacgctatggtcaccaacgttgacgctacctcggtcacctacaagaccaaggacggcgaagagcacaccatcgaatctttctgcaagatttggtccgctggtgttgcggcatccccactgggcaagctcgtcgcagagcagaccggtgttgagaccgaccgcgcaggccgcgtcatggttaacgatgacctgtctgttggcgatcagaagaacgtcttcgtt

SEQ ID NO: 718 - protein, 317 aa, Corynebacterium glutamicum
MSVNPTRPEGGRHHVVVIGSGFGGLFAAKNLAKADVDVTLIDRTNHHLFQPLLYQVATGILSSGEIAPSTRQILGSQENVNVIKGEVTDINVESQTVTASLGEFTRVFEYDSLVVGAGAGQSYFGNDHFAEFAPGMKSIDDALEIRARIIGAFERAEICEDPAERERLLTFVVVGAGPTGVELAGQLAEMAHRTLAGEYKNFNTNSAKIILLDGAPQVLPPFGKRLGRNAQRTLEKMGVNVRLNAMVTNVDATSVTYKTKDGEEHTIESFCKIWSAGVAASPLGKLVAEQTGVETDRAGRVMVNDDLSVGDQKNVFV

SEQ ID NO: 719 - DNA, 816 bp, Corynebacterium glutamicum
  CDS (1)..(816): FRXA01895
caccacctcttccagccactgctgtaccaagtggcaaccggtatcctctcctccggtgaaatcgcaccttccactcgacagatcctgggctcccaggaaaacgtcaacgtcatcaagggcgaagtcaccgacatcaacgtcgagtcccagactgtgaccgcctccctgggcgagttcacccgcgtttttgagtacgattccttggtcgttggtgctggcgcaggtcagtcctacttcggcaatgatcacttcgctgagttcgcacctggcatgaagtccatcgacgatgcactggagattcgtgcacgcatcatcggtgctttcgagcgcgctgagatctgcgaggatccagctgagcgcgaacgcctgctcaccttcgtcgttgttggcgctggcccaaccggtgttgagcttgctggccagttggctgagatggctcaccgcacccttgctggtgagtacaagaacttcaacaccaactccgcaaagatcatcctgcttgatggtgctccacaggttcttcctccattcggtaagcgcctaggccgcaacgcacagcgcaccctggaaaagatgggtgtcaacgttcgcctgaacgctatggtcaccaacgttgacgctacctcggtcacctacaagaccaaggacggcgaagagcacaccatcgaatctttctgcaagatttggtccgctggtgttgcggcatccccactgggcaagctcgtcgcagagcagaccggtgttgagaccgaccgcgcaggccgcgtcatggttaacgatgacctgtctgttggcgatcagaagaacgtcttcgtt

SEQ ID NO: 720 - protein, 272 aa, Corynebacterium glutamicum
HHLFQPLLYQVATGILSSGEIAPSTRQILGSQENVNVIKGEVTDINVESQTVTASLGEFTRVFEYDSLVVGAGAGQSYFGNDHFAEFAPGMKSIDDALEIRARIIGAFERAEICEDPAERERLLTFVVVGAGPTGVELAGQLAEMAHRTLAGEYKNFNTNSAKIILLDGAPQVLPPFGKRLGRNAQRTLEKMGVNVRLNAMVTNVDATSVTYKTKDGEEHTIESFCKIWSAGVAASPLGKLVAEQTGVETDRAGRVMVNDDLSVGDQKNVFV

SEQ ID NO: 721 - DNA, 2409 bp, Corynebacterium glutamicum
  CDS (101)..(2386): RXA00703
ctgggagtcctcttgattttaggttttccacatacccccatatagattgaagaattcatttttcggcatgggttcaattgccgggtctagactgtgacctatgacaacccctccaactgagatttcgaacgtgaatcccaccgcgaatgaatttgatgatccggatgtgggacggcgcattacttctgctgctggtgtgccaggcgttttgcatgcgctccagcatgctgttccgaatcgtgccctgctgccgttgctcaccatgaataaaccaggcggcatcgactgtcctggttgtgcttggcctgagccttccactgccaaccttggtgtggttgagttctgcgagaacggtgccaaggcggtcgccgaggaaacaacacctgatcgtgccggcaaagagttctgggcagagcattctatttatgatctgcgggaaaagaccgatcactggctgggaaagcgtggccgaatcaccgagcccatgttttatgatcgttcttctggcgatgatcactaccgccctatttcttgggatcgtgcatttgcgatcattgcgtcgaagctccgcgagatcgagccagatgaagcggtgttttacacctctggtcgagcacccaatgagccggcttatatgctgcagcttctagcccgccgacttggcacaaataatcttccagactgtggaaacatgtgccacgagtccaccggtactgccttgggtgagaccttgggtttgggcaagggatccgtggtgatggaggatttctacaacactgatttgttgatttccgtgggacaaaacccgggcaccaaccacccacgtgcgttgacggctttcaaagaattgaaggaaaacggtggcaagattctggcgctgaaccccatgccagagaccggtctgatgaaattccgtgagccccaatcagtcaagggcgcgttgagcatttcagacaaacttgctgatgaatacttgcagatccgtcttgatggagaccgcgcattcttccaggcgctcaacaaggaactcatccgtagagatgccctagatcatgcattcttggataaattctgttcaggtgtggatgaaaccatcgagcacctcaaatcactcgatgatgaggttctgctcaagggatgcggtctgacggcagcggagatcaacaaggccgctgacatggtggaaaagtctgacaccgtggtggtgtcatggactctcggggtcacccagcataagaacgctgtgtacaccatccgtgaaatggtgaacttcctgctgcttactggaaatattggtaagcctggcgcaggcactgccccgcttcgtgggcactcaaacgtccagggtgatcgaaccatgggtatttgggagaaaatgccggaggcattccttgctgctcttgaaaacgagtttggtttcgatgtgccccgcaagcacggcttcgacacggtaaattccctgcgagccatgcgcgaaggcaagaccaagttctttctctccctcggtggcaaccttgttcgagtgtcctcagatacgtctgttgtcgaaaagggcatggaatccaatgagctgacggtgcatctgtcgaccaagcccaatggttcacaagcatggcctggtgagcagtcacttatccttccggtgattgctcgaacagataaggatgtccaaaagtcaggcgtccagcgtgtgacagttgaggattctgccggcgctgttcacgcatccactggtaaacgaaccgccaacaaggatctgaatttgaagtccgaatgcgacatcattggaaccatcggtaagcagaccttcggtgatgccttctggcagccgatgattgataactacgatgtggtccgcgatcacatcgaggccaccattcctgggttccacgatttcaaccgtcgcatcgacaaccccggtggattcctcctccccaacggacctcgtgagcgcatcttcaacacatccaatggcaaggcccaattgacggttaatgaaaccaatgtgattgagctacccaaggactatttgcttatgaacacggtacgttcacatgatcaatacaactccacgatttacggtctggatgaccgctaccgcggtgttcgcaatggtcgccgcgtagtgttcgtcaatcctcaagattgtaagcaacgtggtctcaaggatggagacatcgtcgatatcgtctctgtctttgatgatggcgaacgccgagcaccgaatttccgagtggtggaatatgacaccgcgagggactgcgtcaccacgtatttccctgaggccaacgtattggttccattggattcagtagctgaaaaatccaacactccagtgtccaagtcagttgtggttcgccttgaagcaacaggacgtactgcttcttagaaaaacaccagggaattttc

SEQ ID NO: 722 - protein, 762 aa, Corynebacterium glutamicum
MTTPPTEISNVNPTANEFDDPDVGRRITSAAGVPGVLHALQHAVPNRALLPLLTMNKPGGIDCPGCAWPEPSTANLGVVEFCENGAKAVAEETTPDRAGKEFWAEHSIYDLREKTDHWLGKRGRITEPMFYDRSSGDDHYRPISWDRAFAIIASKLREIEPDEAVFYTSGRAPNEPAYMLQLLARRLGTNNLPDCGNMCHESTGTALGETLGLGKGSVVMEDFYNTDLLISVGQNPGTNHPRALTAFKELKENGGKILALNPMPETGLMKFREPQSVKGALSISDKLADEYLQIRLDGDRAFFQALNKELIRRDALDHAFLDKFCSGVDETIEHLKSLDDEVLLKGCGLTAAEINKAADMVEKSDTVVVSWTLGVTQHKNAVYTIREMVNFLLLTGNIGKPGAGTAPLRGHSNVQGDRTMGIWEKMPEAFLAALENEFGFDVPRKHGFDTVNSLRAMREGKTKFFLSLGGNLVRVSSDTSVVEKGMESNELTVHLSTKPNGSQAWPGEQSLILPVIARTDKDVQKSGVQRVTVEDSAGAVHASTGKRTANKDLNLKSECDIIGTIGKQTFGDAFWQPMIDNYDVVRDHIEATIPGFHDFNRRIDNPGGFLLPNGPRERIFNTSNGKAQLTVNETNVIELPKDYLLMNTVRSHDQYNSTIYGLDDRYRGVRNGRRVVFVNPQDCKQRGLKDGDIVDIVSVFDDGERRAPNFRVVEYDTARDCVTTYFPEANVLVPLDSVAEKSNTPVSKSVVVRLEATGRTAS

SEQ ID NO: 723 - DNA, 1038 bp, Corynebacterium glutamicum
  CDS (101)..(1015): RXN00705
gttctggaacaagcactgatgattgggccgagtccacgttggttaatgctctgcatcttcaagaaatcatcgctaaaaattacccggaggctaaataaaaatgggtcggattacccaaaacttgcaggtcccacgcgttgtgtccactgacgagcaagtttttgttaacactcgtccggatactgttgcggtggaggagcctctagaaattcgggttaatggcactgcgcttaccaccactatgcgcacgcccggccatgatattgagttggtgcatggcctcctcttgtcagaaggtctgatcacggatgcttctgaggtttttaccgcccgctattgtgcaggagctgttggcccagataatcaaaatacgtacaacgtcttagaacttgatgtcatccccaaagacaatccggcccgggatcccgtccagaatccctcccataatcccgaaggcagccaacacgaagcactccacatcccaactttccaaccggtacgcgaactaaacctcgtggcagcccaacgcaatgtgctgactacgtctgcttgtggtgtttgtggcacgacgtctattgagcagttgatgaacaagaagggctggcccattacgccgattacaccggatcctcggatgattgtgtcgttgccagataagttgaagtcgaagcagaagattttcgacaaaactggtggggttcatgctgctggtttggccacgcttgatggtgagatgttgattattcgagaggatgtcggtcggcataacgcagctgacaaagttataggaaacatgctgatggcgggaaagctccccttggaaaacactattttggtgatgagttctagggcgtcttttgagcttgtccaaaaggctgccatggctggaatttcgggtgtaatcgctgttggtgctgcaacatcgctggcaatcgaggcggcgcaggattcaggtattttccttgctggttttgttcggggcaacaagtttaaccactatgcgggcgagctcggataatgccagaacaggtagaacag

SEQ ID NO: 724 - protein, 305 aa, Corynebacterium glutamicum
MGRITQNLQVPRVVSTDEQVFVNTRPDTVAVEEPLEIRVNGTALTTTMRTPGHDIELVHGLLLSEGLITDASEVFTARYCAGAVGPDNQNTYNVLELDVIPKDNPARDPVQNPSHNPEGSQHEALHIPTFQPVRELNLVAAQRNVLTTSACGVCGTTSIEQLMNKKGWPITPITPDPRMIVSLPDKLKSKQKIFDKTGGVHAAGLATLDGEMLIIREDVGRHNAADKVIGNMLMAGKLPLENTILVMSSRASFELVQKAAMAGISGVIAVGAATSLAIEAAQDSGIFLAGFVRGNKFNHYAGELG

SEQ ID NO: 725 - DNA, 908 bp, Corynebacterium glutamicum
  CDS (1)..(885): FRXA00705
ccacgcgttgtgtccactgacgagcaagtttttgttaacactcgtccggatactgttgcggtggaggagcctctagaaattcgggttaatggcactgcgcttaccaccactatgcgcacgcccggccatgatattgagttggtgcatggcctcctcttgtcagaaggtctgatcacggatgcttctgaggtttttaccgcccgctattgtgcaggagctgttggcccagataatcaaaatacgtacaacgtcttagaacttgatgtcatccccaaagacaatccggcccgggatcccgtccagaatccctcccataatcccgaaggcagccaacacgaagcactccacatcccaactttccaaccggtacgcgaactaaacctcgtggcagcccaacgcaatgtgctgactacgtctgcttgtggtgtttgtggcacgacgtctattgagcagttgatgaacaagaagggctggcccattacgccgattacaccggatcctcggatgattgtgtcgttgccagataagttgaagtcgaagcagaagattttcgacaaaactggtggggttcatgctgctggtttggccacgcttgatggtgagatgttgattattcgagaggatgtcggtcggcataacgcagctgacaaagttataggaaacatgctgatggcgggaaagctccccttggaaaacactattttggtgatgagttctagggcgtcttttgagcttgtccaaaaggctgccatggctggaatttcgggtgtaatcgctgttggtgctgcaacatcgctggcaatcgaggcggcgcaggattcaggtattttccttgctggttttgttcggggcaacaagtttaaccactatgcgggcgagctcggataatgccagaacaggtagaacag

SEQ ID NO: 726 - protein, 295 aa, Corynebacterium glutamicum
PRVVSTDEQVFVNTRPDTVAVEEPLEIRVNGTALTTTMRTPGHDIELVHGLLLSEGLITDASEVFTARYCAGAVGPDNQNTYNVLELDVIPKDNPARDPVQNPSHNPEGSQHEALHIPTFQPVRELNLVAAQRNVLTTSACGVCGTTSIEQLMNKKGWPITPITPDPRMIVSLPDKLKSKQKIFDKTGGVHAAGLATLDGEMLIIREDVGRHNAADKVIGNMLMAGKLPLENTILVMSSRASFELVQKAAMAGISGVIAVGAATSLAIEAAQDSGIFLAGFVRGNKFNHYAGELG

SEQ ID NO: 727 - DNA, 1134 bp, Corynebacterium glutamicum
  CDS (101)..(1111): RXN00388
gaagagtacttcgaccacgacgactaacaccgcaatttaaaggcttttcaagcctgccccacatcgaagcagttttcacaaagaataaggttggaaaattatgttgcccgtcaaccaaacgtatgcgcagttctcagacactgccttcgtatcggcatacatcatctacgttctggcactcatcctctccctcgtctactacgtaaaacaacaaggcattatcgacgcccgccgcgagcaaacccgcgtcagcgaactcgttggtgcaggcggcagcgctgatgttgatactgacctgcctgatgacatcgccgacggtgtcctcgccgacgaagaccttgcaaaacgcgaagaaaccgcacgcaaactagccaacatgacccaatctctcatgtggctcggcgtcatggtgcacctcgtatccgtcgtgatgcgcgcgctgtctgccagccgattccccttcggcaacctgtatgaatacatcctcatggtcaccctcttcgccatgatcggagccgtactcatcctgcagcgcccacaattccgcgtggtatggccatggatcctcaccccaatgctggcactgctcttctacggtggcacccagctgtactccgacgcagcaccagtcgttccagcactgcagtccttctggttcccgatccacgtttcctccgtctccatcggcgcatccatcggtatcgtctccggtattgcatccctgctgtacatactgcgcatgtggcaaccaaagggtaaagaaaagggcttcttcggcgcagtagcaaaaccactcccatccggaaaaaccctggataacctggcatacaagaccgcgatctggactgtcccaatcttcggcctgggcatcatcttgggtgccatctgggcagaagcagcctggggtcgtttctggggatgggatcctaaggaaacagtctccttcatcacctgggttctctacgctggttacctccacgcacgtgcaactgctggttggcgcaacaccaacgctgcatggatcaacatcctggcgctggtcacgatgatttttaatctgttcttcatcaacatggtcgtatctggtctgcactcttacgccggactgaactaagcacttttggttggcggggt

SEQ ID NO: 728 - protein, 337 aa, Corynebacterium glutamicum
MLPVNQTYAQFSDTAFVSAYIIYVLALILSLVYYVKQQGIIDARREQTRVSELVGAGGSADVDTDLPDDIADGVLADEDLAKREETARKLANMTQSLMWLGVMVHLVSVVMRALSASRFPFGNLYEYILMVTLFAMIGAVLILQRPQFRVVWPWILTPMLALLFYGGTQLYSDAAPVVPALQSFWFPIHVSSVSIGASIGIVSGIASLLYILRMWQPKGKEKGFFGAVAKPLPSGKTLDNLAYKTAIWTVPIFGLGIILGAIWAEAAWGRFWGWDPKETVSFITWVLYAGYLHARATAGWRNTNAAWINILALVTMIFNLFFINMVVSGLHSYAGLN

SEQ ID NO: 729 - DNA, 326 bp, Corynebacterium glutamicum
  CDS (1)..(303): FRXA00388
accctggataacctggcatacaagaccgcgatctggactgtcccaatcttcggcctgggcatcatcttgggtgccatctgggcagaagcagcctggggtcgtttctggggatgggatcctaaggaaacagtctccttcatcacctgggttctctacgctggttacctccacgcacgtgcaactgctggttggcgcaacaccaacgctgcatggatcaacatcctggcgctggtcacgatgatttttaatctgttcttcatcaacatggtcgtatctggtctgcactcttacgccggactgaactaagcacttttggttggcggggt

SEQ ID NO: 730 - protein, 101 aa, Corynebacterium glutamicum
TLDNLAYKTAIWTVPIFGLGIILGAIWAEAAWGRFWGWDPKETVSFITWVLYAGYLHARATAGWRNTNAAWINILALVTMIFNLFFINMVVSGLHSYAGLN

SEQ ID NO: 731 - DNA, 610 bp, Corynebacterium glutamicum
  CDS (101)..(610): FRXA00386
gaagagtacttcgaccacgacgactaacaccgcaatttaaaggcttttcaagcctgccccacatcgaagcagttttcacaaagaataaggttggaaaattatgttgcccgtcaaccaaacgtatgcgcagttctcagacactgccttcgtatcggcatacatcatctacgttctggcactcatcctctccctcgtctactacgtaaaacaacaaggcattatcgacgcccgccgcgagcaaacccgcgtcagcgaactcgttggtgcaggcggcagcgctgatgttgatactgacctgcctgatgacatcgccgacggtgtcctcgccgacgaagaccttgcaaaacgcgaagaaaccgcacgcaaactagccaacatgacccaatctctcatgtggctcggcgtcatggtgcacctcgtatccgtcgtgatgcgcgcgctgtctgccagccgattccccttcggcaacctgtatgaatacatcctcatggtcaccctcttcgccatgatcggagccgtactcatcctgcagcgcccacaattccgcgtggtatggccatggatcctcaccccaatggctggcacttggttttctacggtggcacccagc

SEQ ID NO: 732 - protein, 170 aa, Corynebacterium glutamicum
MLPVNQTYAQFSDTAFVSAYIIYVLALILSLVYYVKQQGIIDARREQTRVSELVGAGGSADVDTDLPDDIADGVLADEDLAKREETARKLANMTQSLMWLGVMVHLVSVVMRALSASRFPFGNLYEYILMVTLFAMIGAVLILQRPQFRVVWPWILTPMAGTWFSTVAPS

SEQ ID NO: 733 - DNA, 1095 bp, Corynebacterium glutamicum
  CDS (101)..(1072): RXA00945
tcacagtaccacccacaagccacaaggagggtatggaggtgggcgtctaaagccaaatttttcccggtgtttgaggcgattgcaccgtacactaatgtgcatgcttgaacgcctcaaacgcctagatccgctcattgtcctcattgtgctggctgtcattgtggcgatcatcattccagttcgcggggttgctgcggattggtttgatgtcgccgtcaagattgccattgcgctgctgttttttctttatggtgcccgcctatccacccaagaggcgctgaatggtctgaagcactggaggcttcacctgactattttggcgatcactttcggaatattcccacttatcggcattgggctcgagccgatgactgcatttgtgtcggaagatatttatcggggaattttgttcctcacgctcgttccgtccaccgtgcagtcatcggtggcgtttacctcgatcgctaaaggcaacgtagctggtgcgattgtgtcggcatcgctctccaaccttgcgggtgttttcctcactccgctgctggtcatgctcatcatgtctgcgggcgggggagttcacgtggattcccaggtcttcctcgacattgcgattcagcttctgctgccgttcatcctcggccaggtatgtaggcgttgggtgaagaattttgcggccaacaaagcaacaaaaatcgtggaccgcggctcgatcgcgatggtcgtgtactccgcgttttctgccggcatggtggctggcatttggtccactgtgagcgttctagagattatctacctcattgttttcgctattctgctggtgatggccatgctgtggttcacgctgttcatggctacacgccttggatttaaccgggcagattccatcgctattcagttctgcggaaccaagaaatccctggccacaggcctcccaatggcggcagtcatcttcggtggcgccaatatcggcctgctcatcttgccgttgatgatcttccaccaagtccagctgatgatttgtgcatggcttgcagctcgttatggtcgtgatgcgcaggaacagaaagccaacgcctaaaagtcctcagtagctagcca

SEQ ID NO: 734 - protein, 324 aa, Corynebacterium glutamicum
MLERLKRLDPLIVLIVLAVIVAIIIPVRGVAADWFDVAVKIAIALLFFLYGARLSTQEALNGLKHWRLHLTILAITFGIFPLIGIGLEPMTAFVSEDIYRGILFLTLVPSTVQSSVAFTSIAKGNVAGAIVSASLSNLAGVFLTPLLVMLIMSAGGGVHVDSQVFLDIAIQLLLPFILGQVCRRWVKNFAANKATKIVDRGSIAMVVYSAFSAGMVAGIWSTVSVLEIIYLIVFAILLVMAMLWFTLFMATRLGFNRADSIAIQFCGTKKSLATGLPMAAVIFGGANIGLLILPLMIFHQVQLMICAWLAARYGRDAQEQKANA

SEQ ID NO: 735 - DNA, 1281 bp, Corynebacterium glutamicum
  CDS (101)..(1258): RXN02556
tgccatcatattaaggccaaattgcttggatcctgggatttatttaattagattaaatccgtagaaattagcccatgaagcatggaaaggcgaaaaccccttgatcgtttccacccagcccattactgatcgcagcgcactctcggcagaacacgcagaggtgatcaaagcaacgcttcctctcgtgggcggcaagattaatgagatcacgccggttttctacaacaagatgtttgcggctcacccagaattgatcgctaacaccttcaaccgtggcaatcagaagcaaggcgatcagcagaaggcgctggcggcttcgattgcaacgtttgccaccatgctcgttactcctgatgctcctgacccagttcagctgctgtcccgcattggccacaagcacgtgtccctcggcattactgctgatcagtacgacattgttcacgagcacctgttcgccgcaatcgttgaggttttgggagcggaaactgtcaccgcacctgtcgctgaagcctgggatgctgtctactggatcatggcaaatgtgctgatcggttttgagaacaacctttatgcttccaacgatctggagcctggcgacgtcttccgcgaagtcaccgtgaccgcgaagaagcagctcagcgcaaccgtctgggaatacaccctggcaggtgagctggttgccccagagccaggtcagtacacctccatcggagtagtgcttgacgacggcgcccgccagctgcgccagtacagcttgctcggcggctccgacaccgagtaccgcattgcggttgaggataacggcgaggtttctggattcctgcgtgatcgcgtatccgttggtgacaagattgaagccaccatcgcggccggcgacctggttcttaacaaggacaccaatccagttgtgctgatttcccagggcatcggctccaccccaatggtgggcatgctcgcaggtatgaaccctgaacgtgacgttgtggttttgcatgctgaccaggccgagtccacctacgcgcaggtggaggaagtgcaggggctcgtcgaaaagctccctaaggctgcgtttgaaatcttctaccgcgacaacgaccagtggctcgaggtcgctggccgcattccatcaggtgcgtccgtgtacctgtgcggtggcgtggaattcttgaagaacgtgcgtgagcagatcgaggcgctcgatgagcagcctcgcgacgtaaacttcgagctcttcgcaccaaacgactggctgatttcctaagcccacaccccagaacttcc

SEQ ID NO: 736 - protein, 386 aa, Corynebacterium glutamicum
LIVSTQPITDRSALSAEHAEVIKATLPLVGGKINEITPVFYNKMFAAHPELIANTFNRGNQKQGDQQKALAASIATFATMLVTPDAPDPVQLLSRIGHKHVSLGITADQYDIVHEHLFAAIVEVLGAETVTAPVAEAWDAVYWIMANVLIGFENNLYASNDLEPGDVFREVTVTAKKQLSATVWEYTLAGELVAPEPGQYTSIGVVLDDGARQLRQYSLLGGSDTEYRIAVEDNGEVSGFLRDRVSVGDKIEATIAAGDLVLNKDTNPVVLISQGIGSTPMVGMLAGMNPERDVVVLHADQAESTYAQVEEVQGLVEKLPKAAFEIFYRDNDQWLEVAGRIPSGASVYLCGGVEFLKNVREQIEALDEQPRDVNFELFAPNDWLIS

SEQ ID NO: 737 - DNA, 1281 bp, Corynebacterium glutamicum
  CDS (101)..(1258): FRXA02556
tgccatcatattaaggccaaattgcttggatcctgggatttatttaattagattaaatccgtagaaattagcccatgaagcatggaaaggcgaaaaccccttgatcgtttccacccagcccattactgatcgcagcgcactctcggcagaacacgcagaggtgatcaaagcaacgcttcctctcgtgggcggcaagattaatgagatcacgccggttttctacaacaagatgtttgcggctcacccagaattgatcgctaacaccttcaacggtggcaatcagaagcaaggcgatcagcagaaggcgctggcggcttcgattgcaacgtttgccaccatgctcgttactcctgatgctcctgacccagttcagctgctgtcccgcattggccacaagcacgtgtccctcggcattactgctgatcagtacgacattgttcacgagcacctgttcgccgcaatcgttgaggttttgggagcggaaactgtcaccgcacctgtcgctgaagcctgggatgctgtctactggatcatggcaaatgtgctgatcggttttgagaacaacctttatgcttccaacgatctggagcctggcgacgtcttccgcgaagtcaccgtgaccgcgaagaagcagctcagcgcaaccgtctgggaatacaccctggcaggtgagctggttgccccagagccaggtcagtacacctccatcggagtagtgcttgacgacggcgcccgccagctgcgccagtacagcttgctcggcggctccgacaccgagtaccgcattgcggttgaggataacggcgaggtttctggattcctgcgtgatcgcgtatccgttggtgacaagattgaagccaccatcgcggccggcgacctggttcttaacaaggacaccaatccagttgtgctgatttcccagggcatcggctccaccccaatggtgggcatgctcgcaggtatgaaccctgaacgtgacgttgtggttttgcatgctgaccaggccgagtccacctacgcgcaggtggaggaagtgcaggggctcgtcgaaaagctccctaaggctgcgtttgaaatcttctaccgcgacaacgaccagtggctcgaggtcgctggccgcattccatcaggtgcgtccgtgtacctgtgcggtggcgtggaattcttgaagaacgtgcgtgagcagatcgaggcgctcgatgagcagcctcgcgacgtaaacttcgagctcttcgcaccaaacgactggctgatttcctaagcccacaccccagaacttcc

SEQ ID NO: 738 - protein, 386 aa, Corynebacterium glutamicum
LIVSTQPITDRSALSAEHAEVIKATLPLVGGKINEITPVFYNKMFAAHPELIANTFNGGNQKQGDQQKALAASIATFATMLVTPDAPDPVQLLSRIGHKHVSLGITADQYDIVHEHLFAAIVEVLGAETVTAPVAEAWDAVYWIMANVLIGFENNLYASNDLEPGDVFREVTVTAKKQLSATVWEYTLAGELVAPEPGQYTSIGVVLDDGARQLRQYSLLGGSDTEYRIAVEDNGEVSGFLRDRVSVGDKIEATIAAGDLVLNKDTNPVVLISQGIGSTPMVGMLAGMNPERDVVVLHADQAESTYAQVEEVQGLVEKLPKAAFEIFYRDNDQWLEVAGRIPSGASVYLCGGVEFLKNVREQIEALDEQPRDVNFELFAPNDWLIS

SEQ ID NO: 739 - DNA, 1200 bp, Corynebacterium glutamicum
  CDS (101)..(1177): RXA01392
gtctgcaatcaccccgaacatttgttcaatcgttgattttcattccacttcgtaatattgttgacatatcatctaaatttccaagagaggacaccacacagtggctaacacgtcatccgattgggcaggcgccccacaaaatgcatcagcagacggcgagttcgttcgcgataccaactacatcgatgaccgcatcgtcgcagacgttccagcgggatccgaaccaattgctcaggaagatggcactttccattggcctgtcgaggctggtcgctaccgtttagtcgctgcccgcgcatgtccatgggcacaccgcactgttatcacccgtcgtcttctcggcctggagaacgtgatctcgcttggtctgaccggcccgactcacgacgttcgttcctggactttcgatttagatccaaaccatcttgatcccgtgctgcagattcctcgtctacaggacgcgtatttcaaccgcttccccgattacccgcgcggcattactgtcccagcgctcgtggaggaatcgtctaagaaggtcgtcaccaacgattacccttccatcaccatcgatttcaatcttgagtggaagcagttccaccgtgagggtgcgcctaacctctaccccgcggagctgcgcgaggagatggcgccggtgatgaagcgcatcttcactgaggtcaacaacggcgtatacaggaccggctttgccggtagccaggaagcgcacaacgaggcgtacaagcggctttgggttgcgttggactggctagaagatcgcttatcgacgcgacgttacctcatgggggatcacatcaccgaggcggatatccgcctctacccaaccctcgtgcgtttcgatgccgtctaccacggacacttcaagtgtggccgcaacaagatcaccgaaatgccgaatctatggggctacctgcgggatcttttccagaccccaggctttggcgacaccaccgatttcaccgaaatcaagcagcactactacatcacccacgcggagattaaccccacccggatcgttccagtcggaccagatctgtctggtttcgcgacaccacacggccgtgaaaagctcggcggatccccatttgctgaaggtgttactctgcctggcccaattcctgcgggcgaagaagtgaaaaaccctgaaccttttcagaagtaactaaggccgcaatccctcga

SEQ ID NO: 740 - protein, 359 aa, Corynebacterium glutamicum
VANTSSDWAGAPQNASADGEFVRDTNYIDDRIVADVPAGSEPIAQEDGTFHWPVEAGRYRLVAARACPWAHRTVITRRLLGLENVISLGLTGPTHDVRSWTFDLDPNHLDPVLQIPRLQDAYFNRFPDYPRGITVPALVEESSKKVVTNDYPSITIDFNLEWKQFHREGAPNLYPAELREEMAPVMKRIFTEVNNGVYRTGFAGSQEAHNEAYKRLWVALDWLEDRLSTRRYLMGDHITEADIRLYPTLVRFDAVYHGHFKCGRNKITEMPNLWGYLRDLFQTPGFGDTTDFTEIKQHYYITHAEINPTRIVPVGPDLSGFATPHGREKLGGSPFAEGVTLPGPIPAGEEVKNPEPFQK

SEQ ID NO: 741 - DNA, 1227 bp, Corynebacterium glutamicum
  CDS (101)..(1204): RXA00800
gactccgcagggatggcctacaagtacggtcacggacttaatttctagattgtaggtagtctcgtgggcacaactgaaatcttattgaaaaggagtgtccatgagcactgtagtgcctggaattgtcgcactgtccaagggtgcaccggtagaaaaagtaaacgttgttgtccctgatccaggtgctaacgatgtcatcgtcaagattcaggcctgcggtgtgtgccacaccgacttggcctaccgcgatggcgatatttcagatgagttcccttacctcctcggccacgaggcagcaggcattgttgaggaggtaggcgagtccgtcacccacgttgaggtcggcgatttcgtcatcttgaactggcgtgcagtgtgcggcgagtgccgtgcatgtaagaagggcgagccaaagtactgctttaacacccacaacgcctctaagaagatgaccctggaagacggcaccgagctgtccccagcactgggtattggcgcgttcttggaaaagaccctggtccacgaaggccagtgcaccaaggttaaccctgaggaagatccagcagcagctggccttctgggttgtggcatcatggcaggccttggcgctgcggtgaacaccggtgatattaagcgtggcgagtccgtagcagtcttcggccttggtggcgtgggcatggcagctattgctggcgccaagattgctggcgcttccaagatcattgctgttgatatcgatgagaagaagctggagtgggcgaaggaattcggcgcaacccacaccattaattcctctggtcttggtggcgaaggtgatgcctctgaggtcgtggcaaaggttcgtgagctcaccgatggtttcggcaccgatgtctccatcgatgcggtaggcatcatgccgacctggcagcaggcgttttactcccgtgaccatgcaggccgcatggtgatggtgggcgttccaaacctgacgtctcgcgtagatgttcctgcgattgatttttacggtcgcggtggatccgtgcgccctgcatggtacggcgactgcctgcctgagcgtgatttcccaacttatgtggatctgcacctgcagggtcgtttcccactggataagtttgtttctgagcgtattggtcttgatgatgttgaagaggctttcaacaccatgaaggctggcgacgtgctgcgttctgtggtggagatctaaatggctcacgacggattgcg

SEQ ID NO: 742 - protein, 368 aa, Corynebacterium glutamicum
MSTVVPGIVALSKGAPVEKVNVVVPDPGANDVIVKIQACGVCHTDLAYRDGDISDEFPYLLGHEAAGIVEEVGESVTHVEVGDFVILNWRAVCGECRACKKGEPKYCFNTHNASKKMTLEDGTELSPALGIGAFLEKTLVHEGQCTKVNPEEDPAAAGLLGCGIMAGLGAAVNTGDIKRGESVAVFGLGGVGMAAIAGAKIAGASKIIAVDIDEKKLEWAKEFGATHTINSSGLGGEGDASEVVAKVRELTDGFGTDVSIDAVGIMPTWQQAFYSRDHAGRMVMVGVPNLTSRVDVPAIDFYGRGGSVRPAWYGDCLPERDFPTYVDLHLQGRFPLDKFVSERIGLDDVEEAFNTMKAGDVLRSVVEI

SEQ ID NO: 743 - DNA, 1011 bp, Corynebacterium glutamicum
  CDS (101)..(988): RXA02143
tcttcatcactatttacttcattcagtaggcagtaaggaatcctcaacgttgttgaggttccctatgcccttcacttccacagtcgagattcaaagggaaatgatggaaaccaacccgcagaccccagagggaaatagcatggctaaaccctctgctaagaaggtcaagaatcgccgcaaggtccggcgcaccgtcgcaggtgcattggctctgaccattggactgagcggagcaggaatcctcgcaaccgcgatcactccagatgctcaagttgctaccgctcagcgtgacgatcaggcacttatctccgagggtaaagacctctacgatgtcgcctgcatcacctgccacggcgtaaacctccaaggtgttgaggaccgcggtccttccctcgtaggtgttggcgaaggcgcagtgtacttccaagttcactccggccgtatgccaatactgcgtaacgaggctcaggctgagcgcaaggctcctcgttacaccgaggcacagacccttgcgatcgctgcatatgttgcagctaatggcggtggcccaggactcgtttacaacgaggacggcaccctcgccatggaggagctccgtggcgaaaactacgacggacagattacctccgccgacgtcgctcgcggcggagatctgttccgcctgaactgtgcatcctgccacaacttcactggtcgtggtggcgcactgtcctctggtaagtacgcaccaaacctggatgctgcaaacgagcaggaaatctaccaggctatgcttaccggtcctcagaacatgcctaagttctccgatcgtcagctctccgcagatgagaagaaggacatcatcgccttcatcaagtccaccaaggagactccatcacctggtggttactcactcggtagcttgggcccagtggctgagggtctgttcatgtgggtattcggcatcttggtcctcgtggccgccgctatgtggattggatcacgttcatgagtaacaacaacgacaaacag

SEQ ID NO: 744 - protein, 296 aa, Corynebacterium glutamicum
MMETNPQTPEGNSMAKPSAKKVKNRRKVRRTVAGALALTIGLSGAGILATAITPDAQVATAQRDDQALISEGKDLYDVACITCHGVNLQGVEDRGPSLVGVGEGAVYFQVHSGRMPILRNEAQAERKAPRYTEAQTLAIAAYVAANGGGPGLVYNEDGTLAMEELRGENYDGQITSADVARGGDLFRLNCASCHNFTGRGGALSSGKYAPNLDAANEQEIYQAMLTGPQNMPKFSDRQLSADEKKDIIAFIKSTKETPSPGGYSLGSLGPVAEGLFMWVFGILVLVAAAMWIGSRS

SEQ ID NO: 745 - DNA, 502 bp, Corynebacterium glutamicum
  CDS (101)..(502): RXN03096
aagatcatgctcatcgaagccggcgcccgaagatggcagttggctggcatgggtccttatcgcaggcgccgttgtcacctcactgctcaccttgtacaccatggttctggtctggtccaaggccttctggcgcgaccgtaaagacgcccccgatggagcaaccgcactagcaagacccgcacctttggtagatatccaagacgaagtcgccgttaaagaccgcaacgatgtcggacggatgccttggggcatggtcttctccactgccctgttggtttccgcatcccttgctgtatccgtgctcgcaggaccactgtcatctattactggacgcgccgccgaatccgcacaagatgtcaacatctaccgcgccgcagtactcggcccaactacctcgacccatcacgcacactcgagatggagcgttacgacgccaaccgcgatgacatcaaccaccgcgtcgacaccaatggaacggaggaccaaccatgatcagtggatt

SEQ ID NO: 746 - protein, 134 aa, Corynebacterium glutamicum
MVLVWSKAFWRDRKDAPDGATALARPAPLVDIQDEVAVKDRNDVGRMPWGMVFSTALLVSASLAVSVLAGPLSSITGRAAESAQDVNIYRAAVLGPTTSTHHAHSRWSVTTPTAMTSTTASTPMERRTNHDQWI

SEQ ID NO: 747 - DNA, 504 bp, Corynebacterium glutamicum
  CDS (101)..(481): RXN02036
ctaaaatggaaggcaatggatacccgccgcatgaacctccgccaatggaaaatcctcgttgccctcatctctgctgcagtggcggctctcggagggtggtgtgcatattccttttgggcacctcgccgacaccgtctcctgggactgcgggggaggcagctgcgccaccaacgatttggtatccctgttcatgccggccgccttcatgagtaccctcgccgcctgcgtatttggcgcgtgggccataggtttgatcgctcccgcactattcatcgcggtgactgcctgggcatttcgctccggcgtgcaggctgcgattgccgacggctacacgtccgcgacttccgtcggcttcgaaatgactgtctcgctcattcttttcatcatcgcaggtctgtgctttctgggctggatccccatgttcatcaacaaccgccaagtcgcgcgcaaggtccgcgagagggctgcgggcttgagcaattaggctctcgcttttcgacgttt

SEQ ID NO: 748 - protein, 127 aa, Corynebacterium glutamicum
VHIPFGHLADTVSWDCGGGSCATNDLVSLFMPAAFMSTLAACVFGAWAIGLIAPALFIAVTAWAFRSGVQAAIADGYTSATSVGFEMTVSLILFIIAGLCFLGWIPMFINNRQVARKVRERAAGLSN

SEQ ID NO: 749 - DNA, 882 bp, Corynebacterium glutamicum
  CDS (101)..(859): RXN02765
tctgaacttttccgcatcgacccagatgaggtttaccccgacgacgacgccacctgcgaattcaacccatggccgtatcctcgcggattttaggagataaatgtctaatcaattacccgatcacgtccgcgacgccttccaagtaggtgcgggacctgccgaacaactcggtcaagcttgggacttcggattccgcgtcggcaacactgtgttcgccaaagtgacggcgccggaagtgtcgggctggtcgtcgaaaacccgcgaaaccctgaaaccagaaggcgtgcgcgtcgtacgaccgatccgctccaccgacggccgatttgtggttgcggggtggcgcgcatcggtgttctctacgggaacgatcagcaagcgagtcgatgagacggtcgttgcgggtcttcgtttggcagatgcattagtggatacgcatgcaccggaacctgtggacaatgtgtttaaccgtgctgatgtgcaggcctgggaagagcagcccggtcgaatcggtgaattgttggagccgattaatcgcgtgaaccaggttggtcatgcggatatgttggcgacaacgctgtatgcgggaactcagccacctgcagtgacggatttggtgccagtgctgcgtccgcatggtttcactgcggcattggtgatcgttgatgggttgctgctgggtgcggttgatgagggaattctgcggaggttttcgcatttgccggaaattgagcagctggttttgagggcatttttgttccgtcgaaacttgcaggagttctctgagaacaacgatccgaatgttatttcgaacctaaacagggtggaatcgacactcgtgtcgtatgtttctgacaagatttgaggtatgtcggaatacaaacc

SEQ ID NO: 750 - protein, 253 aa, Corynebacterium glutamicum
MSNQLPDHVRDAFQVGAGPAEQLGQAWDFGFRVGNTVFAKVTAPEVSGWSSKTRETLKPEGVRVVRPIRSTDGRFVVAGWRASVFSTGTISKRVDETVVAGLRLADALVDTHAPEPVDNVFNRADVQAWEEQPGRIGELLEPINRVNQVGHADMLATTLYAGTQPPAVTDLVPVLRPHGFTAALVIVDGLLLGAVDEGILRRFSHLPEIEQLVLRAFLFRRNLQEFSENNDPNVISNLNRVESTLVSYVSDKI

SEQ ID NO: 751 - DNA, 1059 bp, Corynebacterium glutamicum
  CDS (101)..(1036): RXN02206
ggcaggatctgctgctgcggctaggagggttatctcttcattcacccgatctaccgtactaccttatgacctcagtagtgtggtgggcgtgaaacagcgaatggtcggttcaagtggtttgcgggtatccaggctcggtttgggcacctcaacatggggctcgggcaccgagctggctgaggcaggcgatatctttaaggcgttcatcaattctggtggcacgcttatcgacgtctcccccaactacaccaccggcgtcgcggaagaaatgctcggcacgatgttggatgcggaagtctctcgttcggctgtcgtcatttcctccagcgcaggtgtcaaccccgctctgccgctcggccgacgtgtggattgctcccgccgcaatttgattgcccaattagatgtcaccctgcgggcattaaacactgactatttggatttgtggtctgtgggctattgggatgagggcaccccaccgcatgaggtggccgatactttggattacgccgtgcgcaccggccgagtccgatatgccggtgtccgaggatattccggttggcagttagcggtcacccacgctgcatccaatcatgcagcggcctccgcccgccccgtggtcgttgcacaaaatgaatacagcctgctggaacgccgcgcagaacaagaactcctccctgccacccaacacctaggtgtcggattctttgctggcgctccgctggggcaaggcgtgctgactgctaaataccgctccgaaattccccatgattccagagctgcatccacaggacgcgacgcagaagtccaaagctacctagataatcgaggccgcatcattgtcgatgctcttgatactgcagccaaaggattaggcattagccccgctgtcacagccaccacctgggtgcgtgatcgtcccggagtgacagctgtcatcgtgggcgctcgcacacatgaacagctgtcacatcttctcaaggcggaatcggtgactttgccaacaccaatcacacaagcccttgatgatgtctccctgtgacttggtccaattacattcac

SEQ ID NO: 752 - protein, 312 aa, Corynebacterium glutamicum
MVGSSGLRVSRLGLGTSTWGSGTELAEAGDIFKAFINSGGTLIDVSPNYTTGVAEEMLGTMLDAEVSRSAVVISSSAGVNPALPLGRRVDCSRRNLIAQLDVTLRALNTDYLDLWSVGYWDEGTPPHEVADTLDYAVRTGRVRYAGVRGYSGWQLAVTHAASNHAAASARPVVVAQNEYSLLERRAEQELLPATQHLGVGFFAGAPLGQGVLTAKYRSEIPHDSRAASTGRDAEVQSYLDNRGRIIVDALDTAAKGLGISPAVTATTWVRDRPGVTAVIVGARTHEQLSHLLKAESVTLPTPITQALDDVSL

SEQ ID NO: 753 - DNA, 747 bp, Corynebacterium glutamicum
  CDS (101)..(724): RXN02554
gcttttgaagtgtgtcgcgtgtgcggactgaaatagtttccgcttcaacttggttgctaaggataggctccataaaaataaccaaaggcggaaaatttcaatgtcacacactaagccatccattgccatcctcggtgctggccgagtgggttcttcacttgccaggtcagcggtcgccgcaggctatgaggtaaaggttgctggttcaggtgctgtggacaaaatcgctcttaccgctgagatccttatgcccggcgcggttccaagcactgctgaccaggctgtaaaggatgcagatattgtgttcttggctgttcccctgcataaattccgcagtgtcaatccagccactttagagggcaagatcgttattgacacgatgaaccactgggttccggtcaatggtgagttggaggaaattgatcaggatccgcgcagcacttcggagattattgcggagtttttcgcgggatcaaccatggtgaagtcttttaaccacattggttatcacgagattgagcaggatgcgggtaccgggcgtgcgattgcgtatgccacggatgatgtggatgcaggtgcccaggttgcacagctaattaagagttttgggtttgttcctttaaatattggcgcattggaaaacggccgtattctggaacctggccaagaagctttcggcgcgcaccttaataaagattcgcgcctagaacttgttaatcagcggtagtacctcgatcttcagccaac

SEQ ID NO: 754 - protein, 208 aa, Corynebacterium glutamicum
MSHTKPSIAILGAGRVGSSLARSAVAAGYEVKVAGSGAVDKIALTAEILMPGAVPSTADQAVKDADIVFLAVPLHKFRSVNPATLEGKIVIDTMNHWVPVNGELEEIDQDPRSTSEIIAEFFAGSTMVKSFNHIGYHEIEQDAGTGRAIAYATDDVDAGAQVAQLIKSFGFVPLNIGALENGRILEPGQEAFGAHLNKDSRLELVNQR

SEQ ID NO: 755 - DNA, 933 bp, Corynebacterium glutamicum
  CDS (101)..(910): RXN01204
ttacagcgagtttttcagacgtccatcgcaccgtgcacaacaacatttcaggtgcacggcccgaacacgggagagaacgctgagcgttacaacactgtccatgaagggcgaattccacgcccccgatttggacaaagaatttttcccggggcacgtaaccgatagtggtgaagtcgtgaacatgctgttcaccgatttcgctaatggttggttcgcaatggaccgcatcgtattgatccgtcttcttatgacggcagtcgttgtggtcttcttcctttgggctatgcgcaagccaaagcttgttccgcatggcgtccagaattttgcagagtacgcactcgatttcgttggtattcacatcgctgaagacatcctcggaaagaagaaaggtcgtcggttcctgccgatcctggccaccatcttcttcgcggctctgttgatgaaccttgcaacgatcatcccgggactaaacatctcctccaactcacgtattgcattcccaatcgtgatggcggtagctggttacatcgcgtttatctacgcaggctctaagcgttacggattcttcaaatatgtgaagtcttctgttgtgattccgaacattccaccagcacttcacgtcttggtggttccaattgagttcttctctacattcatcttgaggccagtcaccctggcactgcgtttgatggccaacttccttgctggccacatcatcctggttctgcttttctccgcaacgaacttcttcttcttccagttcaacggatggacagcaatgtccggcgtaaccatcttgatggcagtactcttcacggtttacgagatcattgttatcttcctgcaggcatacatcttcgctctgctggtcgctgtatacattgagctttcacttcacgcggattctcactagatgaaaaaggtcgctattaa

SEQ ID NO: 756 - protein, 270 aa, Corynebacterium glutamicum
MKGEFHAPDLDKEFFPGHVTDSGEVVNMLFTDFANGWFAMDRIVLIRLLMTAVVVVFFLWAMRKPKLVPHGVQNFAEYALDFVGIHIAEDILGKKKGRRFLPILATIFFAALLMNLATIIPGLNISSNSRIAFPIVMAVAGYIAFIYAGSKRYGFFKYVKSSVVIPNIPPALHVLVVPIEFFSTFILRPVTLALRLMANFLAGHIILVLLFSATNFFFFQFNGWTAMSGVTILMAVLFTVYEIIVIFLQAYIFALLVAVYIELSLHADSH

SEQ ID NO: 757 - DNA, 862 bp, Corynebacterium glutamicum
  CDS (101)..(862): FRXA01204
ttacagcgagtttttcagacgtccatcgcaccgtgcacaacaacatttcaggtgcacggcccgaacacgggagagaacgctgagcgttacaacactgtccatgaagggcgaattccacgcccccgatttggacaaagaatttttcccggggcacgtaaccgatagtggtgaagtcgtgaacatgctgttcaccgatttcgctaatggttggttcgcaatggaccgcatcgtattgatccgtcttcttatgacggcagtcgttgtggtcttcttcctttgggctatgcgcaagccaaagcttgttccgcatggcgtccagaattttgcagagtacgcactcgatttcgttggtattcacatcgctgaagacatcctcggaaagaagaaaggtcgtcggttcctgccgatcctggccaccatcttcttcgcggctctgttgatgaaccttgcaacgatcatcccgggactaaacatctcctccaactcacgtattgcattcccaatcgtgatggcggtagctggttacatcgcgtttatctacgcaggctctaagcgttacggattcttcaaatatgtgaagtcttctgttgtgattccgaacattccaccagcacttcacgtcttggtggttccaattgagttcttctctacattcatcttgaggccagtcaccctggcactgcgtttgatggccaacttccttgctggccacatcatcctggttctgcttttcttcgcaacgaacttcttcttcttccagttcaacggatggacagcaatgtccggcgtaaccatcttgatggcagtactcttcacggtttacgagatcattgttatcttcctgcaggcatacatcttcgct

SEQ ID NO: 758 - protein, 254 aa, Corynebacterium glutamicum
MKGEFHAPDLDKEFFPGHVTDSGEVVNMLFTDFANGWFAMDRIVLIRLLMTAVVVVFFLWAMRKPKLVPHGVQNFAEYALDFVGIHIAEDILGKKKGRRFLPILATIFFAALLMNLATIIPGLNISSNSRIAFPIVMAVAGYIAFIYAGSKRYGFFKYVKSSVVIPNIPPALHVLVVPIEFFSTFILRPVTLALRLMANFLAGHIILVLLFFATNFFFFQFNGWTAMSGVTILMAVLFTVYEIIVIFLQAYIFA

SEQ ID NO: 759 - DNA, 1764 bp, Corynebacterium glutamicum
  CDS (101)..(1741): RXA01201
tcgggcaaactcgagcgtctgcgggcaagcttcgcataaagacacgacgaattagacaacattagtaatgctggaagaaacaaccgagagcaggaagaacatggcggagctgacgatctcctccgatgagatccgtagcgcgattgcgaactacacctcgagctactccgcggaggcctcccgtgaggaggtcggcgtggttatttcggccgctgacggtatcgcccaggtttcgggcctcccgtcagtaatggcgaatgagctcctcgaattcccgggcggcgtcatcggcgtcgcacagaaccttgaagctgaccgagtcggcgtcgtggtcctgggtaactacgagctacttaaagaaggcgaccaagttcgtcgtactggagacgttctgtctatcccagtcggcgaggcattccttggccgcgttatcaacccccttggccagccaattgacggcctgggcgaaattgcatccgaagaggaccgcgtcctcgagcttcaggcaccaaccgtgcttgagcgccagcctgtcgaggagcctttggcaaccggcatcaaggctatcgatgcaatgaccccaatcggccgcggtcagcgtcagctgatcattggtgaccgtaagactggcaagaccgcagtctgtgtcgataccatccttaaccagaaggccaactgggagaccggcgacaagaccaagcaggttcgctgcatctacgtcgcaatcggtcagaagggctccaccattgcagccctgcgtaagaccctcgaggagcagggcgctctcgagtacaccaccatcgtggctgcacccgcttccgatgctgcaggcttcaagtggcttgcaccattcgctggcgctgctctcgcccagcactggatgtaccagggcaaccacgtcctggtcatctacgatgatctgaccaagcaggctgaggcataccgtgctatctccctgctgctgcgtcgcccaccgggccgcgaagcatacccaggtgacgtcttctacctgcactcccgtctgctggagcgcgctgcgaagctgtccgatgaactaggcgcaggttctattacagcactgccaatcattgagaccaaggctaatgacgtttccgccttcattcctaccaacgtgatttccatcaccgacggtcaggtattccttgagtccgacctgttcaaccgtggcgttcgcccggcgatcaacgtcggtgtatccgtctcccgtgtcggtggcgcagctcagaccaagggtatgaagaaggttgccggttctctccgtctggatctggctgcattccgcgacctggaagcattcgctaccttcgcatctgacttggatgctgcatccaagtctcagcttgagcgtggccagcgcctcgttcagctgttgattcagtctgagaacgcacctcaggctgttgagtaccagatcatttctctctggcttgcaggcgaaggcgcattcgacaacgttcctgttgaagatgttcgtcgcttcgagtccgaactgcacgagtacttaggctccaacgctgcacaggtctacgagcagatcgctggtggagctcagctttccgacgagtccaaggaaaccttgctcaaggcaaccgaagatttcaagagcgctttccagaccaccgatggcacccctgtcatcaacgagcctgaggttgaagcactcgatgcaggccaggtcaagaaagaccagctcaccgtttcccgcaaggtcagcaagaagtaaggcagcgagcctacactaaa

SEQ ID NO: 760 - protein, 547 aa, Corynebacterium glutamicum
MAELTISSDEIRSAIANYTSSYSAEASREEVGVVISAADGIAQVSGLPSVMANELLEFPGGVIGVAQNLEADRVGVVVLGNYELLKEGDQVRRTGDVLSIPVGEAFLGRVINPLGQPIDGLGEIASEEDRVLELQAPTVLERQPVEEPLATGIKAIDAMTPIGRGQRQLIIGDRKTGKTAVCVDTILNQKANWETGDKTKQVRCIYVAIGQKGSTIAALRKTLEEQGALEYTTIVAAPASDAAGFKWLAPFAGAALAQHWMYQGNHVLVIYDDLTKQAEAYRAISLLLRRPPGREAYPGDVFYLHSRLLERAAKLSDELGAGSITALPIIETKANDVSAFIPTNVISITDGQVFLESDLFNRGVRPAINVGVSVSRVGGAAQTKGMKKVAGSLRLDLAAFRDLEAFATFASDLDAASKSQLERGQRLVQLLIQSENAPQAVEYQIISLWLAGEGAFDNVPVEDVRRFESELHEYLGSNAAQVYEQIAGGAQLSDESKETLLKATEDFKSAFQTTDGTPVINEPEVEALDAGQVKKDQLTVSRKVSKK

SEQ ID NO: 761 - DNA, 1572 bp, Corynebacterium glutamicum
  CDS (101)..(1549): RXN01193
gtgtggccaaccaggcacgtcaggcacagatcacccaggaaatcacagagattgttggtggcgcaggcgcgctcgccgacagcggagaaagtgactaattatgactacagctcttgaagagcagaacgcacagcaggcagccactgccggccgtgtcgtgcgtgtcattggtgcggtcgtcgacgtggagtttccccgcggcgagctgccagcactgtacaacgcacttactgtagaggtaaccctcgaatcagttaagaagaccgttgttctcgaggttgctcagcacctcggcgacaacctcatccgcaccatcgctatggcaccaaccgacggacttgtccgcggtgctgctgtaaccgatactgcacgcccaatttccgtaccagtgggcgatgttgttaagggccacgtattcaacgctttgggcgactgcctagacgacgtttccctgaacaacaacccagagatcgagcgttggggcatccaccgcgagccaccatcattcgatcagcttgagggtaagaccgagatcctggaaacaggcatcaaggttatcgaccttctcaccccttacgttaagggtggaaagatcggcctcttcggtggtgcaggtgtgggtaagaccgttcttatccaggaaatgatcacccgtattgcacgtgagttctccggtacttccgtgttcgcaggtgttggtgagcgtacccgtgagggcaccgacctcttcctcgaaatggaagaaatgggcgttctccaggacaccgccctggtgttcggtcagatggatgagccaccaggagtcggtatgcgcgtggctctgtccggcctgaccatggcggagtacttccgcgatgttcagaaccaggacgtgctgctgttcatcgacaacatcttccgtttcacccaggcaggttctgaggtttccacccttctgggtcgtatgccttccgccgtgggttaccagccaaccctggctgacgagatgggtgttctccaggagcgcattacctccaccaagggccgttcgattacctctctgcaggccgtttacgttcctgccgatgactacaccgacccggctccagcgaccaccttcgctcacttggatgcaaccaccgagcttgaccgctccattgcttccaagggtatttacccagcagtgaacccactgacctccacctctcgtattctcgagccagcaatcgttggtgagcgtcactacgaggtttctcagcgtgtcatcggcattctgcagaagaacaaggaacttcaggacatcatcgccatccttggtatggacgagctttctgaagaggacaagatcaccgttgcacgtgcgcgtcgcatcgagcgcttcctgggtcagaacttcttcgttgcagagaagttcaccggtcttcctggctcctacgtgccactgaccgacaccgtcgacgctttcgagcgtatttgcaacggcgacttcgaccactacccagagcaggctttcaacggcctcggtggtttggacgatgtcgaagctgcatacaagaagctgaccggaaagtaaggtagagacacatggctgaa

SEQ ID NO: 762 - protein, 483 aa, Corynebacterium glutamicum
MTTALEEQNAQQAATAGRVVRVIGAVVDVEFPRGELPALYNALTVEVTLESVKKTVVLEVAQHLGDNLIRTIAMAPTDGLVRGAAVTDTARPISVPVGDVVKGHVFNALGDCLDDVSLNNNPEIERWGIHREPPSFDQLEGKTEILETGIKVIDLLTPYVKGGKIGLFGGAGVGKTVLIQEMITRIAREFSGTSVFAGVGERTREGTDLFLEMEEMGVLQDTALVFGQMDEPPGVGMRVALSGLTMAEYFRDVQNQDVLLFIDNIFRFTQAGSEVSTLLGRMPSAVGYQPTLADEMGVLQERITSTKGRSITSLQAVYVPADDYTDPAPATTFAHLDATTELDRSIASKGIYPAVNPLTSTSRILEPAIVGERHYEVSQRVIGILQKNKELQDIIAILGMDELSEEDKITVARARRIERFLGQNFFVAEKFTGLPGSYVPLTDTVDAFERICNGDFDHYPEQAFNGLGGLDDVEAAYKKLTGK

SEQ ID NO: 763 - DNA, 778 bp, Corynebacterium glutamicum
  CDS (15)..(755): FRXA01193
caccaggagtcggtatgcgcgtggctctgtccggcctgaccatggcggagtacttccgcgatgttcagaaccaggacgtgctgctgttcatcgacaacatcttccgtttcacccaggcaggttctgaggtttccacccttctgggtcgtatgccttccgccgtgggttaccagccaaccctggctgacgagatgggtgttctccaggagcgcattacctccaccaagggccgttcgattacctctctgcaggccgtttacgttcctgccgatgactacaccgacccggctccagcgaccaccttcgctcacttggatgcaaccaccgagcttgaccgctccattgcttccaagggtatttacccagcagtgaacccactgacctccacctctcgtattctcgagccagcaatcgttggtgagcgtcactacgaggtttctcagcgtgtcatcggcattctgcagaagaacaaggaacttcaggacatcatcgccatccttggtatggacgagctttctgaagaggacaagatcaccgttgcacgtgcgcgtcgcatcgagcgcttcctgggtcagaacttcttcgttgcagagaagttcaccggtcttcctggctcctacgtgccactgaccgacaccgtcgacgctttcgagcgtatttgcaacggcgacttcgaccactacccagagcaggctttcaacggcctcggtggtttggacgatgtcgaagctgcatacaagaagctgaccggaaagtaaggtagagacacatggctgaa

SEQ ID NO: 764 - protein, 247 aa, Corynebacterium glutamicum
MRVALSGLTMAEYFRDVQNQDVLLFIDNIFRFTQAGSEVSTLLGRMPSAVGYQPTLADEMGVLQERITSTKGRSITSLQAVYVPADDYTDPAPATTFAHLDATTELDRSIASKGIYPAVNPLTSTSRILEPAIVGERHYEVSQRVIGILQKNKELQDIIAILGMDELSEEDKITVARARRIERFLGQNFFVAEKFTGLPGSYVPLTDTVDAFERICNGDFDHYPEQAFNGLGGLDDVEAAYKKLTGK

SEQ ID NO: 765 - DNA, 739 bp, Corynebacterium glutamicum
  CDS (101)..(739): FRXA01203
gtgtggccaaccaggcacgtcaggcacagatcacccaggaaatcacagagattgttggtggcgcaggcgcgctcgccgacagcggagaaagtgactaattatgactacagctcttgaagagcagaacgcacagcaggcagccactgccggccgtgtcgtgcgtgtcattggtgcggtcgtcgacgtggagtttccccgcggcgagctgccagcactgtacaacgcacttactgtagaggtaaccctcgaatcagttaagaagaccgttgttctcgaggttgctcagcacctcggcgacaacctcatccgcaccatcgctatggcaccaaccgacggacttgtccgcggtgctgctgtaaccgatactgcacgcccaatttccgtaccagtgggcgatgttgttaagggccacgtattcaacgctttgggcgactgcctagacgacgtttccctgaacaacaacccagagatcgagcgttggggcatccaccgcgagccaccatcattcgatcagcttgagggtaagaccgagatcctggaaacaggcatcaaggttatcgaccttctcaccccttacgttaagggtggaaagatcggcctcttcggtggtgcaggtgtgggtaagaccgttcttatccaggaaatgatcacccgtattgcacgtgagttctccggtacttccgtgttcgcaggtgttggtaagcgtacccgtgagggcaccgacctcttcctcgaaatg

SEQ ID NO: 766 - protein, 213 aa, Corynebacterium glutamicum
MTTALEEQNAQQAATAGRVVRVIGAVVDVEFPRGELPALYNALTVEVTLESVKKTVVLEVAQHLGDNLIRTIAMAPTDGLVRGAAVTDTARPISVPVGDVVKGHVFNALGDCLDDVSLNNNPEIERWGIHREPPSFDQLEGKTEILETGIKVIDLLTPYVKGGKIGLFGGAGVGKTVLIQEMITRIAREFSGTSVFAGVGKRTREGTDLFLEM

SEQ ID NO: 767 - DNA, 363 bp, Corynebacterium glutamicum
  CDS (101)..(340): RXN02821
aagtcgcccagatagcgagcggaccactcggtcaactgaataaccccactaaacacttcacagcccgaacacacgggcaccagaaagggaacgacacctcatgaacgagatcatcctggcacaggacgcaaccgagtccaccatcaccggacttggcgctgtcggctacggcatcgcaaccatcggacctggcctcggcatcggcatcctggttggtaaggctctcgagggtatggcacgtcagcctgagatggctggacagctccgtaccaccatgttcctgggcatcgccttcgttgaggccctggcactgatcggccttgttgctggcttcctgttctaatcagctaacttaaccgaaag

SEQ ID NO: 768 - protein, 80 aa, Corynebacterium glutamicum
MNEIILAQDATESTITGLGAVGYGIATIGPGLGIGILVGKALEGMARQPEMAGQLRTTMFLGIAFVEALALIGLVAGFLF

SEQ ID NO: 769 - DNA, 303 bp, Corynebacterium glutamicum
  CDS (101)..(280): FRXA02821
agcccgaacacacgggcaccagaaagggaacgacacctcatgaacgagatcatcttggcacaggacgcaaccgagtccaccatcaccggaccttggcgctgtgggctacggcatcgcaaccatcggacctggcctcggcatcggcatcttggttggtaaggctctcgagggtatggcacgtcagcctgagatggctggacagctccgtaccaccatgttcctgggcatcgccttcgttgaggccctggcactgatcggccttgttgctggcttcctgttctaatcagctaacttaaccgaaag

SEQ ID NO: 770 - protein, 60 aa, Corynebacterium glutamicum
VGYGIATIGPGLGIGILVGKALEGMARQPEMAGQLRTTMFLGIAFVEALALIGLVAGFLF

SEQ ID NO: 771 - DNA, 632 bp, Corynebacterium glutamicum
  CDS (1)..(609): RXA01200
ggctgtcttcggtggaaaagtgagccatctgttctcgaagtcctcaaggacgccgcagagcagacctggtccactccacgcgagttccgcgctggactagtccaacttggccgtcgcgcccttcttcgctctgcggagaaacagggtcagcttggtcaggtggaagatgaactgttccgactcagccgaatcctggatcgcgaaagcaagctgactcagcttctttcagatcgcactcaggaaattggcggtcgacgtgacctcctggctaaggtgctctacggcaaggtaactgctgttaccgaagccctcgcactgcaggctattggtcgccctgagcacaacccaattgacgatatcgcagctttggctggcgctgtagcagagctacagggtcgttccgttgcacatgtcgttaccgcagttgaactcaacgagggacagcaacaagcgctagctgaaaagctgggacgtatttatggtcgtgcgatgagcatccactccgaggttgataccagcctcctcggtggaatgatcatccgcgtcggagacgaagtaattgacggcagcacctcgggcaaactcgagcgtctgcgggcaagcttcgcataaagacacgacgaattagacaa

SEQ ID NO: 772 - protein, 203 aa, Corynebacterium glutamicum
GCLRWKSEPSVLEVLKDAAEQTWSTPREFRAGLVQLGRRALLRSAEKQGQLGQVEDELFRLSRILDRESKLTQLLSDRTQEIGGRRDLLAKVLYGKVTAVTEALALQAIGRPEHNPIDDIAALAGAVAELQGRSVAHVVTAVELNEGQQQALAEKLGRIYGRAMSIHSEVDTSLLGGMIIRVGDEVIDGSTSGKLERLRASFA

SEQ ID NO: 773 - DNA, 495 bp, Corynebacterium glutamicum
  CDS (101)..(472): RXA01194
acttcgaccactacccagagcaggctttcaacggcctcggtggtttggacgatgtcgaagctgcatacaagaagctgaccggaaagtaaggtagagacacatggctgaaatcaccgttgaactggtgtctgtagagcgcatgctgtgggccggccaggcctccatcgtgactgcacagaccaccgagggtgagatcggcgtgctgcccgatcacgagcctcttctcggccaattggttgagaacggtgtcgtgaccatccagccgatcgacggcgaaaagcttatcgccggcgtttcggatggattcctctccgtatctaaggaaaaggtgacgatcctcgcggacttcgccgtctgggcgaatgaggttgataccgcatccgccgaggctgaccttaattcggacgacgagctggccaaggcacacgccgaggctgggctgcgcgcggtccgccgcagcagcgaaggtctctaaacctccgtttagctgaagta

SEQ ID NO: 774 - protein, 124 aa, Corynebacterium glutamicum
MAEITVELVSVERMLWAGQASIVTAQTTEGEIGVLPDHEPLLGQLVENGVVTIQPIDGEKLIAGVSDGFLSVSKEKVTILADFAVWANEVDTASAEADLNSDDELAKAHAEAGLRAVRRSSEGL

SEQ ID NO: 775 - DNA, 1098 bp, Corynebacterium glutamicum
  CDS (101)..(1075): RXA01202
agaaagaccagctcaccgtttcccgcaaggtcagcaagaagtaaggcagcgagcctacactaaatgactgtccaagcaactgaagggaggcgtgtgaaccatggcaacaattcgtgaattgcgtgaccgaattcgttcggttaactcaaccaagaagatcaccaaggctcaagagctcatcgccacctctcgcatcaccaaggcacagggtcgcgtcgcggcagctgcgccgtacgccgaggaaatccagcgcgtgctggagcgcctcgcgtcggcaagctccctagaccacccaatgctgcgtgagcgtgaaggcggcaagcgagccgccgtgctcgtggttacttctgaccgcggcatggctggtggctacaaccacaacgttctgaaaaaggcagcggagctggaaaagcttcttgctgaaagtggatacgaagtggttcgttatgtcaccggcaaaaagggcgtcgactactacaagttccgcgctgaagatgtggctggcacctggactggattctcacaggatccagactgggcagctacccacaacgtgcgccgtcacctcattgatggtttcaccgccagctctgaaggtgaagctgcatggcgcgagggactgaacctaccagaaggccaggatatccagggcttcgaccaggttcacgtggtctacaccgagttcatctccatgctgactcaaaacccagtagtgcaccaactgctgcctgttgagccagtcatcgaagatgaaattttcgaaaaaggcgaggatctgctgtcctcttccggcgaagtcgaacccgactacgagttcgagccggatgcagacactctgcttgaggcactgcttccgcagtacgtctctcgtaggctgttctccatcttcttggaggctgcagctgcagagtccgcttcacgtcgaaacgcgatgaagtctgcgactgacaacgctacggaactggtcaaggacctgtcccgtgtggccaaccaggcacgtcaggcacagatcacccaggaaatcacagagattgttggtggcgcaggcgcgctcgccgacagcggagaaagtgactaattatgactacagctcttgaa

SEQ ID NO: 776 - protein, 325 aa, Corynebacterium glutamicum
MATIRELRDRIRSVNSTKKITKAQELIATSRITKAQGRVAAAAPYAEEIQRVLERLASASSLDHPMLREREGGKRAAVLVVTSDRGMAGGYNHNVLKKAAELEKLLAESGYEVVRYVTGKKGVDYYKFRAEDVAGTWTGFSQDPDWAATHNVRRHLIDGFTASSEGEAAWREGLNLPEGQDIQGFDQVHVVYTEFISMLTQNPVVHQLLPVEPVIEDEIFEKGEDLLSSSGEVEPDYEFEPDADTLLEALLPQYVSRRLFSIFLEAAAAESASRRNAMKSATDNATELVKDLSRVANQARQAQITQEITEIVGGAGALADSGESD

SEQ ID NO: 777 - DNA, 1773 bp, Corynebacterium glutamicum
  CDS (101)..(1750): RXN02434
cttcaatagtcaaaaccagcaaactaattttttaagttttacgtaactggccccaccgcttgtggcaggccttgcgttttgacattgaaggaccctttttatgcgcacttttgccgcttatattgccattgatggcctcagcttttcctaccccaacacccacgttttaagcgatatttcgctcaccgttgccaatggcgatatcgccggactgattggtgaaaacggcgcaggaaaatccaccctgctcagcctcatcgctggcgtcatggaacccgaccagggcaggatttacctccccgaacgcaccggattcatcgcccaagaaacagacttaccgtttgaacaacccgtgcagtcgcttatcgacgccgccgtcgccccagtgcgcgcggtcgatgccgcgattacagatttgtccaccaagcttggcgacgcctccctcagcgccgaagagcaggcgcaagtcgccacagatttcgatgcagcgctaggcgctgcagaagaactcggactgtgggaattagatgcacgtattgaaaccatcgtcgcgggtctcggccttgccgaggtggatcgcagcactcccattggtgagctttccggcggtcagcgccgcagattcgcattggcagcgctgctgttggaaccacacgatgctctgattttcgatgagcccaccaaccacctcgacgacacagccgtagatttcctcatctcggagatttcccgtttcaaaggtccagtgctgatcgccagccacgatcgcttcttcctcgactccgtctgtaccgagttaatcgacctcgatcctgcacttggacctgagggcggatccggcgaagaagtaaaacaagccgtgtcttttggtggtggattttctgaatacatcaaagaacgcgagacccgccgcacccgctgggctcagttgtacaccgcacaagaaaccgagcgggaaaaactcgaagaaaccaccggcaccaccgaatcggatattttccacagctcggtttccaaatcggaagctaaaatcaccgcgaaattttacgcagaccgggcagctaaaactcaaggcaaccgcgtccgctccgccaaaaaccgcctgaaggaattggaacgctatgaaatcccagcacctccaaagccactggaattccaaggcatcccagaagcctccggaaacggtcacggtgaaacactagaagtgcgggctattgctgtggaaaacaggcttcaacccttgactttccacatcgatcccggcgaccacatcctggtcgaaggccccaacggtgtcggtaaatccaccctgctgagcgttctggaaggcgtgcttgaaccaaccgaaggtgaattgatcgtccccgaagggctgaaagttgcgcgcctgaaacaggacgatcagtggacggaaaagcagttgaacacccccgtcgacgaactgttcgccgccctatcgaaaggtccggtcggactcaacctcgtggagatggggctgttgagggagacgtcgcaaagcagcccgctacgggccctatcgctcggccaacgccggcgcgtctcgctcgggctcatcctggcgagcccaccagatcttttgcttcttgacgagcccaccaaccacctctccctcgcgctgagcgaagaactcgagtcggcgatagaaaaattccccggtcgcgttattctggccagccacgataggtggatcagaaaacgttggacggggaagaaaatcagcctgagccgttaaaccctactgaacaggaacct

SEQ ID NO: 778 - protein, 550 aa, Corynebacterium glutamicum
MRTFAAYIAIDGLSFSYPNTHVLSDISLTVANGDIAGLIGENGAGKSTLLSLIAGVMEPDQGRIYLPERTGFIAQETDLPFEQPVQSLIDAAVAPVRAVDAAITDLSTKLGDASLSAEEQAQVATDFDAALGAAEELGLWELDARIETIVAGLGLAEVDRSTPIGELSGGQRRRFALAALLLEPHDALIFDEPTNHLDDTAVDFLISEISRFKGPVLIASHDRFFLDSVCTELIDLDPALGPEGGSGEEVKQAVSFGGGFSEYIKERETRRTRWAQLYTAQETEREKLEETTGTTESDIFHSSVSKSEAKITAKFYADRAAKTQGNRVRSAKNRLKELERYEIPAPPKPLEFQGIPEASGNGHGETLEVRAIAVENRLQPLTFHIDPGDHILVEGPNGVGKSTLLSVLEGVLEPTEGELIVPEGLKVARLKQDDQWTEKQLNTPVDELFAALSKGPVGLNLVEMGLLRETSQSSPLRALSLGQRRRVSLGLILASPPDLLLLDEPTNHLSLALSEELESAIEKFPGRVILASHDRWIRKRWTGKKISLSR

SEQ ID NO: 779 - DNA, 1407 bp, Corynebacterium glutamicum
  CDS (101)..(1384): RXN00684
agtcacacctaaaagtgatagccatcacgaatctttaggaaaagtgattcaaacttcactgtgatcggcttcggccacacacaagtgtcaggagatgacaatgacttcccagacttcccaacaatccacctcaaccggtggatgcccattcgggcacacatcagagtccaccagccatcacggctaccagcctttcgatatgcacaacccgtttcctgcatataaagaactccgtcaggaagagccagtgatgttcgatgagcgcatcggctactgggtggtaaccaaatatgacgacatcaaaaccacctttgatgactgggaaacattctcctctgaaaatgcacaagccccagtccgcaagcgtggacctcaggcaacccaaatcatgaccgatggcggcttcactgcatactccggattatcagctcgtattccaccagagcacacccgcatccgcgcaatcgcacaaaaggccttcacgccacgccgctataaagcactcgaaccagatatccgagcaatggtgattgatcgtgtggagaaaatgttggcgaatgatcaacacgtcggcgatatggtgtcagatcttgcctacgacattccaaccatcacgatcctgacgctgatcggtgcagatattttcatggtggtcacctacaagcggtggtcagattcccgtgcggccatgacctggggcgatcttagtgatgaagagcagatcccacacgcacacaatttggttgagtactggcaggaatgccaacgcatggtagctgatgcacatgcacacggtggcgacaacctcaccgctgatctagtgcgagcacagcaagagggtcaagaaatcaccgatcatgagattgcttctttgctgtactccctgctttttgcggggcacgaaacaaccaccacgttgatctccaattgtttccgagttctcctcgatcatccagagcagtggcaagccattctagagaatccaaaactgattcctgcggcagtggatgaggtcttgcggtactccggctcgatcgtggggtggcgtcgaaaagcattaaaagacaccgagatcggcggcgttgccattaaggaaggcgatggtgttctgctgctcatgggttccgcgaaccgcgatgaagctcgctttgaaaatggcgaggaattcgatatcagccgcgctaatgcgcgcgagcacctgtcttttggtttcggcatccactattgcctaggaaacatgctggccaaacttcaagccaagatctgtctcgaggaagtcaccaggcttgttccttccctgcacttggttgcggacaaagctatcgggttccgggagaacctctccttccgcgtccccacttctgttcccgtgacttggaacgcttaacgctttattaaataaggaga

SEQ ID NO: 780 - protein, 428 aa, Corynebacterium glutamicum
MTSQTSQQSTSTGGCPFGHTSESTSHHGYQPFDMHNPFPAYKELRQEEPVMFDERIGYWVVTKYDDIKTTFDDWETFSSENAQAPVRKRGPQATQIMTDGGFTAYSGLSARIPPEHTRIRAIAQKAFTPRRYKALEPDIRAMVIDRVEKMLANDQHVGDMVSDLAYDIPTITILTLIGADIFMVVTYKRWSDSRAAMTWGDLSDEEQIPHAHNLVEYWQECQRMVADAHAHGGDNLTADLVRAQQEGQEITDHEIASLLYSLLFAGHETTTTLISNCFRVLLDHPEQWQAILENPKLIPAAVDEVLRYSGSIVGWRRKALKDTEIGGVAIKEGDGVLLLMGSANRDEARFENGEEFDISRANAREHLSFGFGIHYCLGNMLAKLQAKICLEEVTRLVPSLHLVADKAIGFRENLSFRVPTSVPVTWNA

SEQ ID NO: 781 - DNA, 978 bp, Corynebacterium glutamicum
  CDS (101)..(955): RXN00387
ttccgcgccggcgccaacttcgacggcaccgggctgaccaccttctgctttgaagcgcacgatttctccgccgactacctcgccaacgggccaggccgagatgttccgctcgaatatttcctacgcagtcggcgacgacatccaaaacgacccagaaacctgggaagactacgaacttcgcgtcaaccacccactgcgcatcgaaggcgaccgcgtctaccttcagggccacggcttcgccccaacattcaccgtgacctggccaaatggcgagacccgcacccagaccgtgcagtggcgcccagacgacccgaccttcttcctgtcctcaggcgtggtccgtttcgatccacccgccggcatgtacccagacctttacgagcgccgccaaaaccagttggccatccagggacttttcgcaccgaccgcggaatgggaaggcgacaacaacgaactgctgacctcctcctacccggcgatgcgtgacccagccgtggcgatcgatatttaccgcggcgacaatggcctcgataccggcatcggacagtcattgttcagcctggactctagtctcatgcacagcggcgtgctgcaaaaaattgagcgcgtcaacctccaaatcggcgacaccgtcaccctggatgatggcaccaccgtctccttcgacggcgcgtcagaatttgccaactaccagatcagccgcgaccccacacaaaactgggtgctggtcaccaccgtgatttcgctggtctccctggttggatccctgatgatccgacgccgccgcatttgggtgcgtttctatccacaagaaaacggaaccacccgcgtggaaaccggcggacttgcccgcaccgaccgcgcaggctggggtggcgaatacgagaaattccaccgcgaactgctgggtctgaaggaggaagatgaagacgaagagtacttcgaccacgacgactaacaccgcaatttaaaggcttt

SEQ ID NO: 782 - protein, 285 aa, Corynebacterium glutamicum
MFRSNISYAVGDDIQNDPETWEDYELRVNHPLRIEGDRVYLQGHGFAPTFTVTWPNGETRTQTVQWRPDDPTFFLSSGVVRFDPPAGMYPDLYERRQNQLAIQGLFAPTAEWEGDNNELLTSSYPAMRDPAVAIDIYRGDNGLDTGIGQSLFSLDSSLMHSGVLQKIERVNLQIGDTVTLDDGTTVSFDGASEFANYQISRDPTQNWVLVTTVISLVSLVGSLMIRRRRIWVRFYPQENGTTRVETGGLARTDRAGWGGEYEKFHRELLGLKEEDEDEEYFDHDD

SEQ ID NO: 783 - DNA, 18 bp, Artificial Sequence
  Description of Artificial Sequence: Primer
ggaaacagtatgaccatg

SEQ ID NO: 784 - DNA, 17 bp, Artificial Sequence
  Description of Artificial Sequence: Primer
gtaaaacgacggccagt

What is claimed is:

1. An isolated nucleic acid molecule comprising the nucleotide sequence of SEQ ID NO:1, or the complement thereof, wherein said nucleic acid molecule encodes a polypeptide having 6-phosphogluconolactonase activity and wherein said nucleic acid molecule comprises less than 5 kb of nucleotide sequences which naturally flank the nucleotide sequence of SEQ ID NO:1.

2. An isolated nucleic acid molecule comprising the nucleotide sequence of SEQ ID NO:1, or the complement thereof, wherein said nucleic acid molecule encodes only a polypeptide having 6-phosphogluconolactonase activity.

3. An isolated nucleic acid molecule comprising a nucleotide sequence which encodes a polypeptide comprising the amino acid sequence of SEQ ID NO:2, or the complement thereof, wherein the polypeptide has 6-phosphogluconolactonase activity and wherein said nucleic acid molecule comprises less than 5 kb of nucleotide sequences which naturally flank the nucleotide sequence encoding the amino acid sequence of SEQ ID NO:2.

4. An isolated nucleic acid molecule comprising a nucleotide sequence which has at least 95% identity with the nucleotide sequence of SEQ ID NO:1, or the complement thereof, wherein said nucleic acid molecule encodes a polypeptide having 6-phosphogluconolactonase activity and wherein said nucleic acid molecule comprises less than 5 kb of nucleotide sequences which naturally flank the nucleotide sequence of SEQ ID NO:1.

5. An isolated nucleic acid molecule which encodes only a polypeptide comprising the amino acid sequence of SEQ ID NO:2 and having 6-phosphogluconolactonase activity, or the complement thereof.

6. An isolated nucleic acid molecule comprising a nucleotide sequence which has at least 95% identity with the nucleotide sequence of SEQ ID NO:1, or the complement thereof, wherein said nucleic acid molecule encodes only a polypeptide having 6-phosphogluconolactonase activity.

7. An isolated nucleic acid molecule comprising the nucleic acid molecule of any one of claims 1, 2 or 3-6 and a nucleotide sequence encoding a heterologous polypeptide.

8. A vector comprising the nucleic acid molecule of any one of claims 1, 2 or 3-6.

9. A method of producing a polypeptide encoded by an expression vector comprising the nucleic acid molecule of any one of claims 1, 2 or 3-6, comprising culturing a host cell transformed with said vector in an appropriate culture medium to, thereby, produce the polypeptide.

10. The vector of claim 8, which is an expression vector.

11. An isolated host cell transformed with the expression vector of claim 10.

12. The host cell of claim 11, wherein said cell is a microbial cell.

13. The host cell of claim 12, wherein said cell belongs to the genus Corynebacterium or Brevibacterium.

14. A method for producing an amino acid, comprising culturing a cell transformed with the vector of claim 10 such that the amino acid is produced.

15. The method of claim 14, wherein said method further comprises the step of recovering the amino acid from said culture.

16. The method of claim 14, wherein said cell belongs to the genus Corynebacterium or Brevibacterium.

17. The method of claim 14, wherein said cell is selected from the group consisting of: Corynebacterium glutamicum, Corynebacterium herculis, Corynebacterium lilium, Corynebacterium acetoacidophilum, Corynebacterium acetoglutamicum, Corynebacterium acetophilum, Corynebacterium ammoniagenes, Corynebacterium fujtokense, Corynebacterium nitrilophilus, Brevibacterium ammoniagenes, Brevibacterium flavum, Brevibactenrm ketosoreductum, Brevibacterium linens, Brevibacterium parafinoliticum, and those strains set forth in Table 3.

18. The method of claim 14, wherein said amino acid a proteinogenic or nonproteinogenic amino acid.

19. The method of claim 14, wherein said amino acid is selected from the group consisting of lysine, glutamate, glutamine, alanine, aspartate, glycine, serine, threonine, methionine, cysteine, valine, leucine, isoleucine, arginine, proline, histidine, tyrosine, phenylalanine, and tryptophan.

20. The isolated nucleic acid molecule of claims 3-6, wherein the nucleotide sequence has at least 97% identity to the nucleotide sequence of SEQ ID NO:1.

21. The isolated nucleic acid molecule of any one of claims 1, 3 or 4, wherein said nucleic acid molecule comprises less than 4 kb, 3 kb, 2 kb, 1 kb, 0.5 kb or 0.1 kb of nucleotide sequences which naturally flank the nucleotide sequence of SEQ ID NO:1 or the nucleotide sequence encoding the amino acid sequence of SEQ ID NO:2.

* * * * *

UNITED STATES PATENT AND TRADEMARK OFFICE
CERTIFICATE OF CORRECTION

PATENT NO. : 7,270,984 B1  Page 1 of 1
APPLICATION NO. : 09/602740
DATED : September 18, 2007
INVENTOR(S) : Markus Pompejus et al.

It is certified that error appears in the above-identified patent and that said Letters Patent is hereby corrected as shown below:

In Claim 18, at column 128, line 41, insert "is" so it should correctly appear as --said amino acid is a--; and In Claim 20, at column 128, line 48, replace "3-6" with "4 or 6" so it should correctly appear as --claims 4 or 6--.

Signed and Sealed this

Seventh Day of April, 2009

JOHN DOLL
*Acting Director of the United States Patent and Trademark Office*